(12) United States Patent
Breuer et al.

(10) Patent No.: US 8,932,839 B2
(45) Date of Patent: Jan. 13, 2015

(54) METHOD FOR THE BIOCATALYTIC CYCLIZATION OF TERPENES AND CYCLASE MUTANTS EMPLOYABLE THEREIN

(75) Inventors: Michael Breuer, Darmstadt (DE);
Bernhard Hauer, Fußgönheim (DE);
Dieter Jendrossek, Tübingen (DE);
Gabriele Siedenburg, Stuttgart (DE);
Juergen Pleiss, Asperg (DE); Demet Sirim, Stuttgart (DE); Silvia Racolta, Stuttgart (DE)

(73) Assignee: BASF SE, Ludwigshafen (DE)

( * ) Notice: Subject to any disclaimer, the term of this patent is extended or adjusted under 35 U.S.C. 154(b) by 93 days.

(21) Appl. No.: 13/297,798

(22) Filed: Nov. 16, 2011

(65) Prior Publication Data
US 2012/0237991 A1 Sep. 20, 2012

Related U.S. Application Data

(60) Provisional application No. 61/414,434, filed on Nov. 17, 2010, provisional application No. 61/499,228, filed on Jun. 21, 2011, provisional application No. 61/540,028, filed on Sep. 28, 2011.

(51) Int. Cl.
| | |
|---|---|
| *C12P 5/00* | (2006.01) |
| *C12N 1/19* | (2006.01) |
| *C12P 7/02* | (2006.01) |
| *C12N 9/88* | (2006.01) |

(52) U.S. Cl.
CPC ... *C12N 9/88* (2013.01); *C12P 7/02* (2013.01); *C12P 5/007* (2013.01); *C12Y 504/99017* (2013.01)
USPC .............................. 435/155; 435/166; 435/233

(58) Field of Classification Search
CPC .................. C12P 5/007; C12N 9/88
USPC ........................................... 435/155, 166, 233
See application file for complete search history.

(56) References Cited

FOREIGN PATENT DOCUMENTS

WO WO-2010/139719 A2 12/2010

OTHER PUBLICATIONS

Devos et al., (Proteins: Structure, Function and Genetics, 2000, vol. 41: 98-107.*
Whisstock et al., (Quarterly Reviews of Biophysics 2003, vol. 36 (3): 307-340.*
Witkowski et al., (Biochemistry 38:11643-11650, 1999.*
Kisselev L., (Structure, 2002, vol. 10: 8-9.*
Neumann et al Biol Chem. 1986, vol. 367, p. 723-729.*
"Nomenclature Committee of the International Union of Biochemistry and Molecular Biology (NC-IUBMB). Enzyme Supplement 5 (1999)", Eur. J. Biochem., 1999, vol. 264, pp. 610-650.
Daum, M. et al., "Genes and Enzymes Involved in Bacterial Isoprenoid Biosynthesis", Current Opinion in Chemical Biology, 2009, vol. 13, pp. 180-188.
Seo, J.-S. et al., "The Genome Sequence of the Ethanologenic Bacterium *Zymomonas mobilis* ZM4" Nature Biotechnology, 2005, vol. 23, No. 1, pp. 63-68.

* cited by examiner

*Primary Examiner* — Tekchand Saidha
*Assistant Examiner* — Md. Younus Meah
(74) *Attorney, Agent, or Firm* — Drinker Biddle & Reath LLP

(57) ABSTRACT

The present invention relates to novel mutants with cyclase activity and use thereof in a method for biocatalytic cyclization of terpenes, such as in particular for the production of isopulegol by cyclization of citronellal; a method for the preparation of menthol and methods for the biocatalytic conversion of further compounds with structural motifs similar to terpene.

22 Claims, 4 Drawing Sheets

```
  1 MGIDRMNSLS RLLMKKIFGA EKTSYKPASD TIIGTDTLKR PNRRPEPTAK
 51 VDKTIFKTMG NSLNNTLVSA CDWLIGQQKP DGHWVGAVES NASMEAEWCL
101 ALWFLGLEDH PLRPRLGNAL LEMQREDGSW GVYFGAGNGD INATVEAYAA
151 LRSLGYSADN PVLKKAAAWI AEKGGLKNIR VFTRYWLALI GEWPWEKTPN
201 LPPEIIWFPD NFVFSIYNFA QWARATMVPI AILSARRPSR PLRPQDRLDE
251 LFPEGRARFD YELPKKEGID LWSQFFRTTD RGLHWVQSNL LKRNSLREAA
301 IRHVLEWIIR HQDADGGWGG IQPPWVYGLM ALHGEGYQLY HPVMAKALSA
351 LDDPGWRHDR GESSWIQATN SPVWDTMLAL MALKDAKAED RFTPEMDKAA
401 DWLLARQVKV KGDWSIKLPD VEPGGWAFEY ANDRYPDTDD TAVALIALSS
451 YRDKEEWQKK GVEDAITRGV NWLIAMQSEC GGWGAFDKDN NRSILSKIPF
501 CDFGESIDPP SVDVTAHVLE AFGTLGLSRD MPVIQKAIDY VRSEQEAEGA
551 WFGRWGVNYI YGTGAVLPAL AAIGEDMTQP YITKACDWLV AHQQEDGGWG
601 ESCSSYMEID SIGKGPTTPS QTAWALMGLI AANRPEDYEA IAKGCHYLID
651 RQEQDGSWKE EEFTGTGFPG YGVGQTIKLD DPALSKRLLQ GAELSRAFML
701 RYDFYRQFFP IMALSRAERL IDLNN
```

Fig. 1a

```
   1 atgggtattg acagaatgaa tagcttaagt cgcttgttaa tgaagaagat
  51 tttcggggct gaaaaaacct cgtataaacc ggcttccgat accataatcg
 101 gaacggatac cctgaaaaga ccgaaccggc ggcctgaacc gacggcaaaa
 151 gtcgacaaaa cgatattcaa gactatgggg aatagtctga ataataccct
 201 tgtttcagcc tgtgactggt tgatcgggca acaaaagccc gatggtcatt
 251 gggtcggtgc cgtggaatcc aatgcttcga tggaagcaga atggtgtctg
 301 gccttgtggt ttttgggtct ggaagatcat ccgcttcgtc caagattggg
 351 caatgctctt ttggaaatgc agcgggaaga tggctcttgg ggagtctatt
 401 tcggcgctgg aaatggcgat atcaatgcca cggttgaagc ctatgcggcc
 451 ttgcggtctt tggggtattc tgccgataat cctgttttga aaaagcggc
 501 agcatggatt gctgaaaaag gcggattaaa aaatatccgt gtctttaccc
 551 gttattggct ggcgttgatc ggggaatggc cttgggaaaa gacccctaac
 601 cttcccctg aaattatctg gttccctgat aattttgtct tttcgattta
 651 taattttgcc caatgggcgc gggcaaccat ggtgccgatt gctattctgt
 701 ccgcgagacg accaagccgc ccgtcgcgcc ctcaagaccg attggatgaa
 751 ctgtttccag aaggccgcgc tcgctttgat tatgaattgc cgaaaaaaga
 801 aggcatcgat cttggtcgc aattttccg aaccactgac cgtggattac
 851 attgggttca gtccaatctg ttaaagcgca atagcttgcg tgaagccgct
 901 atccgtcatg ttttggaatg gattatccgg catcaggatg ccgatggcgg
 951 ttggggtgga attcagccac cttgggtcta tggtttgatg gcgttacatg
1001 gtgaaggcta tcagctttat catccggtga tggccaaggc tttgtcggct
1051 ttgatgatc ccggttggcg acatgacaga ggcgagtctt cttggataca
1101 ggccaccaat agtccggtat gggatacaat gttggccttg atggcgttaa
1151 aagacgccaa ggccgaggat cgtttacgc cggaaatgga taaggccgcc
1201 gattggcttt ggctcgaca ggtcaaagtc aaaggcgatt ggtcaatcaa
1251 actgcccgat gttgaaccg gtggatgggc atttgaatat gccaatgatc
1301 gctatcccga taccgatgat accgccgtcg ctttgatcgc ccttttcctct
1351 tatcgtgata aggaggagtg gcaaaagaaa ggcgttgagg acgccattac
1401 ccgtggggtt aattggttga tcgccatgca aagcgaatgt ggcggttggg
1451 gagcctttga taaggataat aacagaagta tccttttccaa aattccttt
1501 tgtgatttcg gagaatctat tgatccgcct tcagtcgatg taacggcgca
1551 tgttttagag gcctttggca ccttgggact gtcccgcgat atgccggtca
1601 tccaaaaagc gatcgactat gtccgttccg aacaggaagc cgaaggcgcg
1651 tggtttggtc gttggggcgt taattatatc tatggcaccg gtgcggttct
1701 gcctgctttg cggcgatcg gtgaagatat gacccagcct tacatcacca
1751 aggcttgcga ttggctggtc gcacatcagc aggaagacgg cggttggggc
1801 gaaagctgct cttcctatat ggagattgat tccattggga agggcccaac
1851 cacgccgtcc cagactgctt gggctttgat ggggttgatc gcggccaatc
1901 gtcccgaaga ttatgaagcc attgccaagg gatgccatta tctgattgat
1951 cgccaagagc aggatggtag ctggaaagaa gaagaattca ccggcaccgg
2001 attccccggt tatggcgtgg gtcagacgat caagttggat gatccggctt
2051 tatcgaaacg attgcttcaa ggcgctgaac tgtcacgggc gtttatgctg
2101 cgttatgatt tttatcggca attcttcccg attatggcgt taagtcgggc
2151 agagagactg attgatttga ataattga
```

Fig. 1b

METHOD FOR THE BIOCATALYTIC CYCLIZATION OF TERPENES AND CYCLASE MUTANTS EMPLOYABLE THEREIN

RELATED APPLICATIONS

This application claims the benefit under 35 U.S.C. §119 (e) of U.S. Provisional Application 61/414,434, filed Nov. 17, 2010; U.S. Provisional Application 61/499,228, filed Jun. 21, 2011; and U.S. Provisional Application 61/540,028, filed Sep. 28, 2011.

SUBMISSION OF SEQUENCE LISTING

The Sequence Listing associated with this application is filed in electronic format via EFS-Web and hereby incorporated by reference into the specification in its entirety. The name of the text file containing the Sequence Listing is Third_Revised_Sequence_List_13111_00194_US. The size of the text file is 1,428 KB, and the text file was created on May 31, 2012.

The present invention relates to novel methods for cyclizing terpenes using cyclases and to novel mutants with cyclase activity and use thereof in a method for biocatalytic cyclization of terpenes, such as in particular for the production of isopulegol by cyclization of citronellal; a method for the preparation of menthol and methods for the biocatalytic conversion of further compounds with structural motifs similar to terpene.

BACKGROUND OF THE INVENTION

Isopulegol of formula (II) (2-isopropenyl-5-methyl-cyclohexanol) is a terpene that is used as an aroma compound, to generate "flower notes". Moreover, it is an intermediate in the synthesis of menthol from citral.

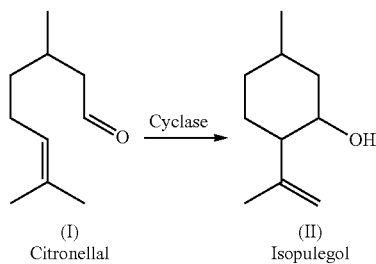

(I)
Citronellal (II)
Isopulegol

Isopulegol isomers occur in nature in a large number of essential oils. As isopulegol is formed relatively easily from citronellal, the compound of formula (I) (3,7-dimethyloct-6-en-1-al), it often occurs accompanying citronellal or is formed during extraction of the essential oil. Isopulegol, which is produced industrially from (+)-citronellal, is as a rule a mixture of different isomers with a high proportion of (−)-isopulegol.

The industrial production of isopulegol is mainly carried out by the chemical cyclization of (+)-citronellal. Originally 80-85% pure raw material obtained from citronella oil was used. Since the 1990s this has increasingly been replaced with the optically purer (+)-citronellal (97.5%) from the so-called Takasago process. Here, geranyldiethyldiamine is isomerized asymmetrically to (+)-citronellal using an Rh-BINAP-complex catalyst (Rh-complex with 2,2'-bis-(diphenylphosphino)-1,1'-binaphthyl).

The chemical synthesis of isopulegol starting from citronellal has been described many times. (+)-Citronellal can be cyclized using a copper-chromium catalyst, zinc bromide, alkylaluminum chloride, a rhodium complex, a solid acid-base catalyst, zeolite or silica gel. In recent times the silica gel method has increasingly been superseded by the method with zinc bromide, as the latter has higher selectivity.

The cyclization of terpenes with the aid of special cyclases is generally known. For example, in nature squalene is cyclized by a squalene-hopene cyclase (SHC) to the pentacyclic hopene.

The gene and protein sequences of squalene-hopene cyclase derived from the bacterium *Zymomonas mobilia* (Zm-SHC) are known (Genpept Accession No AAV90172 2004 and Nat Biotechnol 2005, 23:63-68, cf. SEQ ID NO: 1 and 2).

In international application PCT/EP2010/057696 (WO2010139719 A2), to the complete disclosure of which reference is expressly made herein, polypeptides are proposed as biocatalysts for the cyclization homofarnesol to ambroxan.

The biosynthesis of numerous monoterpenes in the corresponding production organisms has already been elucidated. Frequently this involves cyclization of linear precursor molecules by highly specific biocatalysts. The precursors are generally esters of linear terpene alcohols and diphosphoric acid. One typical example of such a precursor is geranyl pyrophosphate. The pyrophosphate group is eliminated from the molecule enzymatically, and is subsequently hydrolyzed into two phosphate ions. On the other side, a carbocation is formed, which is then able to undergo further intramolecular reaction and which recombines to form a cyclic monoterpene, with elimination of a proton, for example (Curr. Opin. Chem. Biol. 2009, 13: 180-188).

A problem to be solved by the present invention, furthermore, was to find an alternative to the known chemical cyclization methods for terpenes, allowing terpene compounds to be cyclized by means of enzymatic catalysis, such as the linear citronellal to be cyclized to isopulegol, for example.

The problem to be solved by the present invention was furthermore to provide novel biocatalysts that can be used for the cyclization of terpenes, for example of citronellal with formation of isopulegol.

SUMMARY OF THE INVENTION

The above first problem is solved by a method of production of isopulegol of general formula (I)

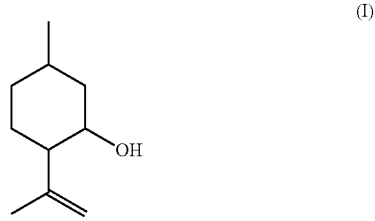

(I)

comprising one reaction step,
wherein citronellal of general formula (II)

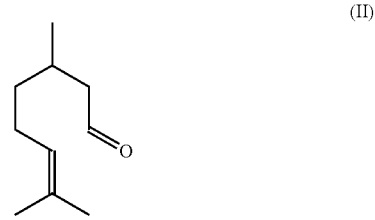

(II)

is cyclized biocatalytically to the corresponding isopulegol of formula (I) by means of an enzyme having the activity of citronellal-isopulegol cyclase.

The above second problem could, surprisingly, be solved by providing mutants of wild-type enzymes, such as Zm-SHC-1 (SEQ ID NO:2). In particular it was in fact found that through targeted introduction of mutations in at least one highly conserved sequence position in said cyclases, in particular squalene-hopene cyclases (cf. alignment of SEQ ID NOs. 2 to 326, below) the enzymatic activity can be influenced in the desired manner.

DESCRIPTION OF THE FIGURES

FIG. 1a shows the wad-type amino acid sequence (SEQ ID NO: 2) of squalene-hopene cyclase 1 from *Zymomonas mobilis* (Zm-SHC-1). Position 486 of saturation mutagenesis is marked.

FIG. 1b shows the wild-type nucleic acid sequence (SEQ ID NO: 1) of Zm-SHC-1. Positions 1456-1458 of saturation mutagenesis are marked.

DETAILED DESCRIPTION OF THE INVENTION

A. General Definitions

Figure 2:
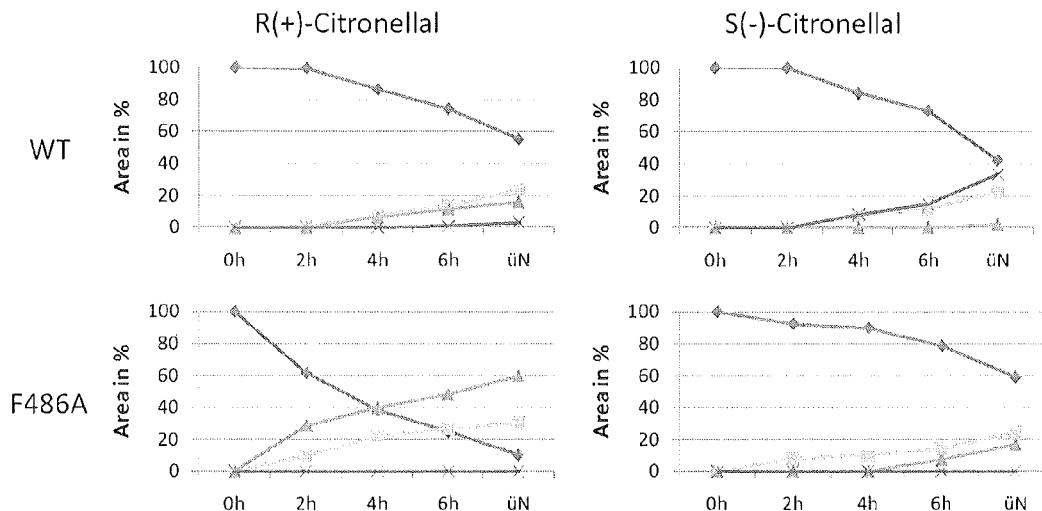
FIG. 2 shows the turnover of the SHC_1 WT protein compared with the F486A mutant as a function of time with 10 mM R(+)- and S(−)-citronellal as substrate. The percentage distribution of substrate and isopulegol product isomers after incubation for various times at 30° C. is shown in each case. Citronellal (diamonds), isopulegol I (squares), isopulegol II (triangles) and isopulegol III (crosses).

"Cyclases" in the sense of the present invention are generally enzymes or enzyme mutants, which in particular display the activity of a citronellal-isopulegol cyclase. Intramolecular transferases from the isomerase subclass are suitable as enzymes with the activity of a citronellal-isopulegol cyclase; i.e. proteins with the EC number EC 5.4. (Enzyme code according to Eur. J. Biochem. 1999, 264, 610-650). In particular they are representatives of EC 5.4.99.17.

Suitable enzymes with the activity of a citronellal-isopulegol cyclase are in particular those cyclases that also bring about the cyclization of homofarnesol to ambroxan or of squalene to hopene (hence sometimes also designated "SHC": squalene hopene cyclase) and which are described in detail in international application PCT/EP2010/057696, to which reference is expressly made here. In particular, cyclases according to the invention are those that are derived by mutation of SHCs.

On the basis of the reversibility of enzymatic reactions, the present invention relates to the enzymatic reactions described herein in both directions of reaction.

"Functional mutants" of a "cyclase" include the "functional equivalents" of such enzymes defined below.

The term "biocatalytic process" refers to any process carried out in the presence of catalytic activity of a "cyclase" according to the invention or of an enzyme with "cyclase activity", i.e. processes in the presence of raw, or purified, dissolved, dispersed or immobilized enzyme, or in the presence of whole microbial cells, which have or express such enzyme activity. Biocatalytic processes therefore include both enzymatic and microbial processes.

The term "stereospecific" means that one of several possible stereoisomers of a compound produced according to the invention is produced with at least one asymmetry center by the action of an enzyme according to the invention in high "enantiomeric excess" or high "enantiomeric purity", for example at least 90% ee, in particular at least 95% ee, or at least 98% ee, or at least 99% ee. The ee % value is calculated from the following formula:

$$ee\% = [X_A - X_B]/[X_A + X_B] * 100,$$

in which $X_A$ and $X_B$ stand for the mole fraction of enantiomers A and B respectively.

"First sphere residues" and "second sphere residues" are amino acid residues which, based on structural analyses of the protein, are assigned a special proximity to the reactive center of the cyclase. The criterion for the first sphere is the distance from the ligand 2-azasqualene, which is given in a published x-ray structure (pdb: 1 ump). These residues were determined automatically with a computer program (ligin.weizmann.ac.il/cgi-bin/lpccsu/LpcCsu.cgi; Sobolev V, Sorokine A, Prilusky J, Abola E E, Edelman M. Automated analysis of interatomic contacts in proteins. Bioinformatics 1999; 15(4): 327-332). This program assumes that two molecules are in contact with each other when the distance between their atoms corresponds to the sum of their van der Waals radii±1 Å. The second sphere includes all amino acids that are located in a radius of 5 Å to each residue of the first sphere. Such residues therefore appear to be especially suitable for undertaking directed mutation, for further targeted modification of the enzyme activity.

"Cyclase activity", determined with a "reference substrate under standard conditions", is e.g. an enzyme activity that describes the formation of a cyclic product from a noncyclic substrate. Standard conditions are e.g. substrate concentrations from 10 mM to 0.2 M, in particular 15 to 100 mM, for example about 20 to 25 mM; at pH 4 to 8, and at temperatures of e.g. 15 to 30 or 20 to 25° C. It can be determined with recombinant cyclase-expressing cells, lysed cyclase-expressing cells, fractions thereof or enriched or purified cyclase enzyme. In particular the reference substrate is a citronellal of formula (II); in particular R(+)-citronellal, or a citronellal racemate, in a concentration from 15 to 100 mM or about 20 to 25 mM, at 20 to 25° C. and pH 4-6, such as 4.5; as is also described in more detail in the examples.

An "F486-analog" position corresponds to position F486 according to SEQ ID NO:2 from the functional standpoint and can be determined by sequence alignment of SHCs from organisms other than *Zymomonas mobilis* as explained herein. For example the F486-analog position of SEQ ID NO:3 is position F449 and of SEQ ID NO:4 position F481 and of SEQ ID NO:5 position F447 and of SEQ ID NO:6 position F438. Corresponding analogies apply to the other sequence positions described concretely for SEQ ID NO: 2 herein, such as the so-called "first sphere residues" and "second sphere residues" or of the DXDD motif and their analogous positions in SEQ ID NO:3 to 326).

"Terpenes" are hydrocarbons that are made up of isoprene units (C5 units), in particular noncyclic terpenes, for example squalene, the carbon number of which is divisible by 5.

"Terpenoids" are substances that are derived from terpenes, in particular noncyclic terpenes, e.g. by additional insertion of carbon atoms and/or heteroatoms, for example citronellal.

"Terpene-like" compounds for the purposes of the present invention comprise in particular hose compounds which fall within the general structural formula (IV) as defined below.

Generally encompassed in accordance with the invention are all isomeric forms of the compounds described herein, such as constitutional isomers and more particularly stereoisomers and mixtures thereof, such as optical isomers or geometric isomers, such as E- and Z-isomers, and also combinations thereof. Where there are two or more centers of asymmetry in a molecule, the invention encompasses all combinations of different conformations of these centers of asymmetry, such as pairs of enantiomers, for example.

"Menthol" encompasses all stereoisomeric forms such as (+)-menthol, (+)-isomenthol, (+)-neomenthol, (+)-neoisomentol, (−)-menthol, (−)-isomenthol, (−)-neomenthol, (−)-neoisomenthol and any desired mixtures thereof.

Citronellal of formula (II) is commercially available both as R(+)-citronellal of formula (R-II) and as S(−)-citronellal of formula (S-II) and as racemate of formula (II).

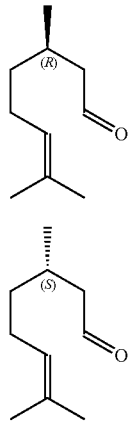

Isopulegol of formula (I)

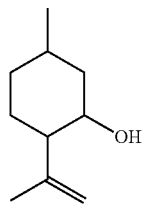

has in positions 1, 3 and 6 in each case an optically active center, so that in principle 4 different diastereomers with in each case 2 enantiomers, thus altogether 8 stereoisomers, are conceivable, starting from the racemate of citronellal of formula (I).

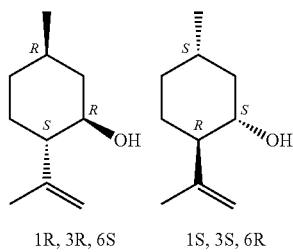

1R, 3R, 6S     1S, 3S, 6R

Isopulegol

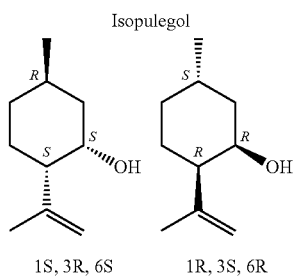

1S, 3R, 6S     1R, 3S, 6R

Neo-Isopulegol

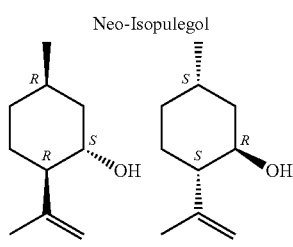

1S, 3R, 6R     1R, 3S, 6S

Iso-Isopulegol 1R, 3R, 6R     1S, 3S, 6S

Epi-Isopulegol

Isopulegol is also called isopulegol I, neo-isopulegol is also called Isopulegol II; iso-isopulegol is also called isopulegol III; epi-isopulegol or neo-iso-isopulegol is also called isopulegol IV.

Unless indicated otherwise, the general chemical definitions that apply herein are as follows:

Alkyl and also all alkyl moieties in radicals derived therefrom, such as hydroxyalkyl, for example: saturated, straight-chain or branched hydrocarbon radicals having 1 to 4, 1 to 6, 1 to 8 or 1 to 10 carbon atoms, e.g.

$C_1$-$C_6$-alkyl: such as methyl, ethyl, propyl, 1-methylethyl, butyl, 1-methylpropyl, 2-methylpropyl and 1,1-dimethylethyl as exemplary representatives of $C_1$-$C_4$-alkyl; and also pentyl, 1-methylbutyl, 2-methylbutyl, 3-methylbutyl, 2,2-dimethylpropyl, 1-ethylpropyl, hexyl, 1,1-dimethylpropyl, 1,2-dimethylpropyl, 1-methylpentyl, 2-methylpentyl, 3-methylpentyl, 4-methylpentyl, 1,1-dimethylbutyl, 1,2-dimethylbutyl, 1,3-dimethylbutyl, 2,2-dimethylbutyl, 2,3-dimethylbutyl, 3,3-dimethylbutyl, 1-ethylbutyl, 2-ethylbutyl, 1,1,2-trimethylpropyl, 1,2,2-trimethylpropyl, 1-ethyl-1-methylpropyl and 1-ethyl-2-methylpropyl, Hydroxy-$C_1$-$C_6$-alkyl, comprising hydroxy-$C_1$-$C_4$-alkyl, such as e.g. hydroxymethyl, 1- or 2-hydroxyethyl, 1-, 2- or 3-hydroxypropyl, 1-hydroxymethylethyl, 1-, 2-, 3- or 4-hydroxybutyl, 1-hydroxymethylpropyl and 2-hydroxymethylpropyl.

Alkenyl stands for mono- or polyunsaturated, more particularly monounsaturated, straight-chain or branched hydrocarbon radicals having 2 to 4, 2 to 6, 2 to 8, 2 to 10 or 2 to 20 carbon atoms and one double bond in any desired position, e.g. $C_2$-$C_6$-alkenyl such as ethenyl, 1-propenyl, 2-propenyl, 1-methylethenyl, 1-butenyl, 2-butenyl, 3-butenyl, 1-methyl-1-propenyl, 2-methyl-1-propenyl, 1-methyl-2-propenyl, 2-methyl-2-propenyl, 1-pentenyl, 2-pentenyl, 3-pentenyl, 4-pentenyl, 1-methyl-1-butenyl, 2-methyl-1-butenyl, 3-methyl-1-butenyl, 1-methyl-2-butenyl, 2-methyl-2-butenyl, 3-methyl-2-butenyl, 1-methyl-3-butenyl, 2-methyl-3-butenyl, 3-methyl-3-butenyl, 1,1-dimethyl-2-propenyl, 1,2-dimethyl-1-propenyl, 1,2-dimethyl-2-propenyl, 1-ethyl-1-propenyl, 1-ethyl-2-propenyl, 1-hexenyl, 2-hexenyl, 3-hexenyl, 4-hexenyl, 5-hexenyl, 1-methyl-1-pentenyl, 2-methyl-1-pentenyl, 3-methyl-1-pentenyl, 4-methyl-1-pentenyl, 1-methyl-2-pentenyl, 2-methyl-2-pentenyl, 3-methyl-2-pentenyl, 4-methyl-2-pentenyl, 1-methyl-3-pentenyl, 2-ethyl-3-pentenyl, 3-methyl-3-pentenyl, 4-methyl-3-pentenyl, 1-methyl-4-pentenyl, 2-methyl-4-pentenyl, 3-methyl-4-pentenyl, 4-methyl-4-pentenyl, 1,1-dimethyl-2-butenyl, 1,1-dimethyl-3-butenyl, 1,2-dimethyl-1-butenyl, 1,2-diethyl-2-butenyl, 1,2-dimethyl-3-butenyl, 1,3-diethyl-1-butenyl, 1,3-dimethyl-2-butenyl, 1,3-dimethyl-3-butenyl, 2,2-diethyl-3-butenyl, 2,3-dimethyl-1-butenyl, 2,3-diethyl-2-butenyl, 2,3-dimethyl-3-butenyl, 3,3-dimethyl-1-butenyl, 3,3-dimethyl-2-butenyl, 1-ethyl-1-butenyl, 1-ethyl-2-butenyl, 1-ethyl-3-butenyl, 2-ethyl-1-butenyl, 2-ethyl-2-butenyl, 2-ethyl-3-butenyl, 1,1,2-triethyl-2-propenyl, 1-ethyl-1-methyl-2-propenyl, 1-ethyl-2-methyl-1-propenyl and 1-ethyl-2-methyl-2-propenyl.

"Oxo", for example, is a radical which together with the C atom to which it is bonded forms a keto group (C═O).

"Methylene" (═$CH_2$), for example, is a radical which together with the C atom to which it is bonded forms a vinyl radical (—CH═$CH_2$).

B. Special Embodiments of the Invention

The present invention relates in particular to the following special embodiments:

1. Enzyme mutant with cyclase activity, selected from mutants of a wild-type enzyme, which comprises an amino acid sequence, selected from SEQ ID NO: 2 to 326 or a partial sequence thereof; wherein the mutant catalyzes at least the cyclization of at least one citronellal isomer (or a mixture of isomers, for example racemate) according to the above definition to at least one isopulegol isomer (or to a pair of diastereomers I to IV, for example I and/or II) according to the above definition, wherein the partial sequence or short form of the cyclase comprises e.g. at least 50, 100, 150, 200, 250, 300, 350, 400, 450, 500, 550, 600, 650 or 700 continuous amino acid residues of one of these sequences, and is accessible e.g. by N- and/or C-terminal shortening of the concrete sequences.

2. Enzyme mutant according to embodiment 1, comprising
   a) a mutation in position F486 of SEQ ID NO: 2 or
   b) a mutation in a sequence selected from SEQ ID NO: 3 to 326, wherein the mutated position corresponds to position F486 of SEQ ID NO: 2 (i.e. is an "F486-analog" position);
   wherein at least the cyclization of at least one citronellal isomer to at least one isopulegol isomer is made possible by the mutation (i.e. the corresponding original or wild-type protein did not catalyze this reaction) or is modified (i.e. the corresponding original or wild-type protein catalyzed this reaction, but e.g. at lower product yield, turnover rate and/or stereospecificity). Moreover, the partial sequence or short form of the cyclase also has this cyclase-typical mutation in a position corresponding to F486 from SEQ ID NO: 2. For example, an N-terminally shortened version of the cyclase according to SEQ ID NO: 2 is an example of said short version. This is characterized by the following N-terminus: (M)KIFGAEKTSYKPASDTIIGTDTLKRPN . . . wherein the N-terminal K corresponds to position 16 of SEQ ID NO:2.

3. Enzyme mutant according to one of the preceding embodiments in which up to 25% or up to 20, 15, 10, 9, 8, 7, 6, 5, 4, 3, 2 or 1% of the amino acid residues, for example 1 to 30, 2 to 25, 3 to 20 or 4 to 15 or 5 to 10 of the amino acid residues, are in each case altered relative to the unmutated wild-type sequence according to SEQ ID NO: 2 to 326, by deletion, insertion, substitution, addition, inversion or a combination thereof.

4. Enzyme mutant according to one of the preceding embodiments, in which the mutation in position F486 of SEQ ID NO:2 or in a position corresponding to this position in one of the sequences according to SEQ ID NO: 3 to 326, is a substitution selected from F486N, F486Q, F486L, F486M, F486E, F486G, F486S, F486V, F486T, F486C, F486I and F486A or optionally selected from F486I1, F486Y, F486W and F486D.

5. Enzyme mutant according to one of the preceding embodiments, in which additionally (or alternatively, but in particular additionally) at least one, for example 1, 2, 3, 4, 5, 6, 7, or 8, mutations in one of the positions W374, D437, D440, F428, W555, Y561, Y702, Y705 (the so-called "first sphere residues") of SEQ ID NO: 2 or in at least one corresponding position selected from these positions, is present in one of the sequences according to SEQ ID NO: 3 to 326.

6. Enzyme mutant according to one of the preceding embodiments, in which there is no mutation in position D437 and/or D439 and/or D440 of SEQ ID NO: 2 (DXDD motif) or the respective corresponding position in one of the sequences according to SEQ ID NO: 3 to 326.

7. Enzyme mutant according to one of the preceding embodiments, in which there is no mutation in position Y702 of SEQ ID NO: 2 or in the corresponding position in one of the sequences according to SEQ ID NO: 3 to 326, or if a mutation is present, this is a substitution Y702F or optionally Y702E or Y702D or corresponding substitution.

8. Enzyme mutant according to one of the preceding embodiments, which optionally is further mutated in at least one, for example 1 to 15, 1 to 10 or 1 to 5, such as 1, 2, 3 or 4, of positions P229, D439, D508, E601, G553, G556, N432, P436, P499, R224, S371, T376, T563, W414 or W624 (the so-called "second sphere residues") of SEQ ID NO: 2 or in at least one corresponding position selected from these positions, in one of the sequences according to SEQ ID NO: 3 to 326; and optionally a further mutation in position E429. L700 and R554 of SEQ ID NO: 2 or the analogous positions of SEQ ID NO: 3 to 326.

9. Enzyme mutant according to one of the preceding embodiments, selected from
   a) the single mutants
      F486X with X=N, Q, L, M, E, G, S, V, T, C, I or A according to SEQ ID NO: 2 or a short version thereof;
      Y702X with X=F, A, C or S according to SEQ ID NO: 2 or a short version thereof;
      Y561X with X=A or S according to SEQ ID NO: 2 or a short version thereof;

wherein the short version comprises e.g. the following N-terminal sequence:

```
(M)KIFGAEKTSYKPASDTIIGTDTLKRPN......
``` b) the multiple mutants F486A/Y702A, F486A/Y561A or F486A/Y705A according to SEQ ID NO: 2
c) the mutants corresponding to a) or b), derived from one of SEQ ID NO: 3 to 325, 10. Enzyme mutant according to one of the preceding embodiments, which comprises at least 50%, for example 50 to 100% or more than 100%, for example >100 to 1000%, in each case determined under standard conditions using a reference substrate that displays citronellal-isopulegol cyclase activity of an enzyme, which has an amino acid sequence according to SEQ ID NO: 2 from position 1 to 725, 2 to 725 or 16 to 725, optionally extended N-terminally with a methionine residue.

11. Enzyme mutant according to embodiment 10, wherein the citronellal-isopulegol cyclase activity is determined under standard conditions using a citronellal, for example the racemate or the R(+) form, as reference substrate.

12. Enzyme mutant according to one of the preceding embodiments, wherein the mutation takes place in an enzyme, and comprises an amino acid sequence according to SEQ ID NO: 2 from position 1 to 725, 2 to 725 or 16 to 725, optionally extended N-terminally with a methionine residue.

13. Nucleic acid sequence coding for a mutant according to one of the preceding embodiments.

14. Expression cassette, comprising a nucleic sequence according to embodiment 13.

15. Recombinant vector, comprising, under the control of at least one regulatory element, at least one nucleic acid sequence according to embodiment 13 or at least one expression cassette according to embodiment 14.

16. Recombinant microorganism, comprising at east one nucleic acid sequence according to embodiment 13 or at least one expression cassette according to embodiment 14 or at least one vector according to embodiment 15.

17. Biocatalytic process for producing isopulegol of general formula (I)

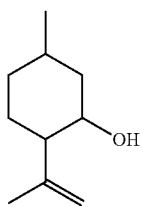

(I)

wherein citronellal of general formula (II)

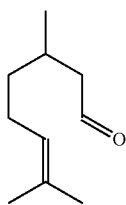

(II)

is cyclized to isopulegol of formula (I) by means of an enzyme of EC class EC 5.4.99, in particular of EC class EC 5.4.99.17, or in the presence of a microorganism expressing this enzyme.

18. Biocatalytic process for producing isopulegol of general form a (I)

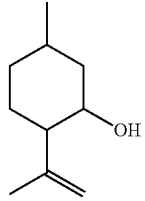

(I)

wherein citronellal of general formula (II)

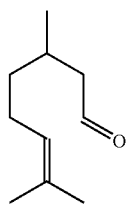

(II)

is cyclized to isopulegol of formula (I) by means of an enzyme mutant according to one of embodiments 1 to 12, or in the presence of a microorganism expressing this enzyme mutant according to embodiment 16.

19. A method of production of menthol formula III

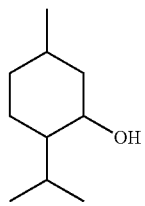

(III)

by
a) cyclizing citronellal to isopulegol by a method according to claim 17 or 18, and
b) catalytically hydrogenating isopulegol to menthol, 20. The method according to claim 19, where the hydrogenation takes place in the presence of hydrogen and a catalyst comprising
30% to 70% by weight of oxygen-containing compounds of nickel, calculated as NiO,
15% to 45% by weight of oxygen-containing compounds of zirconium, calculated as $ZrO_2$,
5% to 30% by weight of oxygen-containing compounds of copper, calculated as CuO, and
0.1% to 10% by weight of oxygen-containing compounds of molybdenum, calculated as $MoO_3$,
the % by weight figures being based on the dry, unreduced catalyst.

21. A method for enzymatic or biocatalytic conversions of compounds of general formula IV

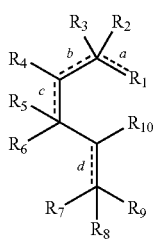

(IV)

in which
"a", "b", "c" and "d", in each case independently of one another, represent a single or double C—C bond, with the proviso that cumulative double bonds are excluded; and with the following provisos:
$R_1$ possesses the following definitions:
(1) when "a" is a double bond:
$R_1$ is selected from
oxo(=O), or
CH—$(CH_2)_n$—Z.
in which n is 0, 1 or 2 and
Z is OH, CHO, C(O)alkyl, such as $C(O)C_1$-$C_4$-alkyl, in particular C(O)—$CH_3$ or C(O)—$CH_2CH_3$; COOH, $C(CH_2)$—CH=$CH_2$; $C(OH)(CH_3)$—CH=$CH_2$; $C(CH_3)$=CH—CH=$CH_2$; or a radical of the formula $C(CH_3)$=CH—$CH_2Y$
in which
Y is OH, $CH_2OH$, COOH, $CH_2C(O)CH_3$; or
(2) when "a" is a single bond:
$R_1$ is selected from
$CH_3$; CHO; $CH_2CH_2OH$; CH=$CH_2$; $CH_2C(O)$ OH; $CH_2CHO$ or $C_3H_6CH(CH_3)CHO$;
wherein, when "a" is a double bond, it has E or Z configuration;
$R_2$ and $R_3$ possess the following definitions:
(1) when "a" and "b" are each a single bond:
$R_2$ and $R_3$ independently of one another are H, alkyl, such as $C_1$-$C_4$-alkyl or OH, or $R_2$ and $R_3$ together are a methylene (=$CH_2$) or oxo (=O) group; or
(2) when "a" or "b" is a double bond, one of the radicals $R_2$ and $R_3$ is absent and the other of the two radicals is H, $C_1$-$C_4$-alkyl, in particular methyl, or OH;
$R_4$ is H or hydroxy-$C_1$-$C_4$-alkyl, in particular Hydroxymethyl;
$R_5$ and $R_6$ possess the following definitions:
(1) when "c" is a single bond:
$R_5$ and $R_6$ are each H, or $R_5$ and $R_6$ together are an oxo (=O) group; or
(2) when "c" is a double bond, one of the radicals $R_5$ and $R_6$ is absent and the other of the two radicals is H;
$R_7$, $R_8$ and $R_9$ possess the following definitions:
(1) when "d" is a single bond:
two of the radicals $R_7$, $R_8$ and $R_9$ in each case independently of one another are H or alkyl, such as $C_1$-$C_4$-alkyl, in particular methyl or ethyl, and the other of the radicals is OH; or
(2) when "d" is a double bond, one of the radicals $R_7$, $R_8$ and $R_9$ is absent and the other of the two radicals in each case independently of one another are H or alkyl, such as $C_1$-$C_4$-alkyl, in particular methyl or ethyl;
$R_{10}$ is H or hydroxy-$C_1$-$C_6$-alkyl, such as hydroxy-$C_1$-$C_4$-alkyl, or mono- or polyunsaturated $C_2$-$C_6$-alkenyl, such as, in particular, H or CH=CH—$C(CH_3)$=$CH_2$ where a compound of the formula IV in stereoisomerically pure form, or a stereoisomer mixture thereof, is reacted using an enzyme of class EC 5.4.99, in particular of class EC 5.4.99.17, or an enzyme mutant according to one of embodiments 1 to 12 or in the presence of a microorganism according to embodiment 16 expressing these enzymes or enzyme mutants.
22. The method according to embodiment 21, in which a compound is converted which is selected from compounds of the formula IVa

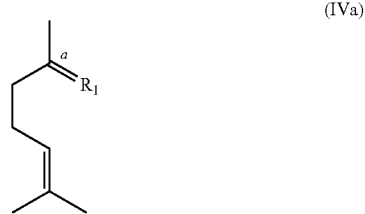

(IVa)

in which $R_1$ possesses the definitions indicated above and in particular is the radical CH—$(CH_2)_n$—Z
in which
n=0 and Z=CHO, or COOH; or
n=1 and Z=OH; or
n=2 and Z=$C(O)CH_3$; COOH, $C(CH_2)$—CH=$CH_2$; $C(CH_3)$=CH—CH=$CH_2$;
or is a radical of the formula $C(CH_3)$=CH—$CH_2Y$
in which Y is OH, $CH_7OH$, COOH, or $CH_2C(O)CH_3$;
and "a" optionally has E or Z configuration;
or of the formula IVb

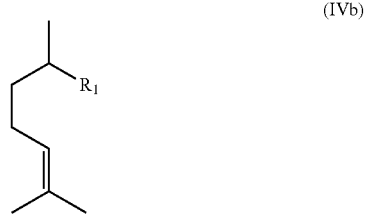

(IVb)

in which $R_1$ possesses the definitions indicated above and in particular is $CH_2CHO$;
or of the formula IVc

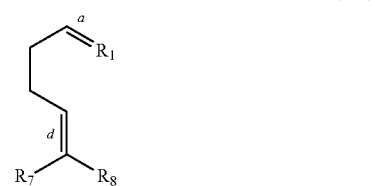

(IVc)

in which
$R_1$ possesses the definitions indicated above, and in particular is CH—CHO; and one of the radicals $R_7$ and $R_8$ is H and the other is $C_1$-$C_4$-alkyl, where in particular $R_7$ is ethyl and the double bonds "a" and "d" have Z configuration.
23. The method according to one of embodiments 20 to 22, in which the compound of the formula IV is selected from citronellal; citral; farnesol; homofarnesol; homofarnesol derivatives, such as homofarnesylic acid; geranylacetone, melonal; nonadienal; and trimethyldecatetraene.

24. Use of an enzyme from EC class EC 5.4.99, in particular from EC class EC 5.4.99.17 for the cyclization of terpenes and/or terpenoids, in particular for the conversion of citronellal to isopulegol.

25. Use of an enzyme mutant according to one of embodiments 1 to 12, a nucleic acid according to embodiment 13, an expression construct according to embodiment 14, a recombinant vector according to embodiment 15 or a recombinant microorganism according to embodiment 1 for the cyclization terpenes and/or terpenoids, and for the conversion of compounds of the general formula IV according to the definition in one of the embodiments 20 to 23.

25. Use according to embodiment 25 for the conversion of citronellal to isopulegol; or for the conversion of squalene to hopene.

26. A method of production of isopulegol of general formula (I)

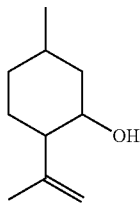

comprising one reaction step,
wherein citronellal of general formula (II)

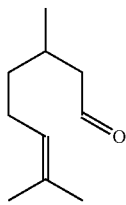

is cyclized biocatalytically to the corresponding isopulegol of formula (I) by means of an enzyme having the activity of a citronellal-isopulegol cyclase.

27. The method according to embodiment 26, wherein the enzyme possesses a polypeptide sequence which either
a) is SEQ ID NO: 2, or
b) in which up to 25%, such as, for example, up to 20, 15, 10, 9, 8, 7, 6, 5, 4, 3, 2 or 1% of the amino acid residues are altered relative to SEQ ID NO: 2 by deletion, insertion, substitution or a combination thereof, and which still has at least 50%, such as, for example, at least 60, 65, 70, 75, 80, 85, 90 or 95%, of the enzymatic activity of SEQ ID NO: 2.

28. The method according to embodiment 26 or 27, wherein the enzyme is encoded by a nucleic acid sequence according to SEQ ID NO: 1 or a functional equivalent thereof.

29. The method according to one of embodiments 26 to 28, wherein the enzyme is encoded by a nucleic acid sequence according to SEQ ID NO: 1 or a functional equivalent thereof, the nucleic acid sequence being part of a gene construct or vector.

30. The method according to one of embodiments 26 to 29, wherein the enzyme is encoded by a nucleic acid sequence according to SEQ ID NO: 1 or a functional equivalent thereof, the nucleic acid sequence being part of a gene construct or vector which are present in a host cell.

31. The method according to one of embodiments 26 to 30, wherein the enzyme is present in a form selected from the group consisting of:
a) free, optionally purified or partly purified polypeptide having the activity of a citronellal-isopulegol cyclase;
b) immobilized polypeptide having the activity of a citronellal-isopulegol cyclase;
c) polypeptide according to a) or b) which is isolated from cells;
d) whole cell, optionally resting or digested cells, comprising at least one polypeptide having the activity of a citronellal-isopulegol cyclase;
e) cell lysate or cell homogenate of the cells described under d).

32. The method according to embodiment 31, wherein the cells are microorganisms, preferably transgenic microorganisms expressing at least one heterologous nucleic acid molecule coding for a polypeptide having the activity of a citronellal-isopulegol cyclase.

33. The method according to one of embodiments 26 to 32, wherein the production of isopulegol takes place in one-phase aqueous systems or in two-phase systems.

34. The method according to one of embodiments 26 to 33, in which the reaction of citronellal to isopulegol takes place at a temperature in the range from 20 to 40° C. and/or at a pH in the range from 4 to 8.

35. The method according to one of embodiments 26 to 34, wherein the enzyme having the activity of a citronellal-isopulegol cyclase is encoded by a gene which has been isolated from a microorganism selected from the group of microorganisms consisting of *Zymomonas mobilis*, *Methylococcus capsulatus*, *Rhodopseudomonas palustris*, *Bradyrhizobium japonicum*, *Frankia* spec. and *Streptomyces coelicolor*, in particular *Zymomonas mobilis*.

36. The method according to one of embodiments 26 to 35, wherein the enzyme having the activity of a citronellal-isopulegol cyclase has been produced by a microorganism which overproduces the enzyme having the activity of a citronellal-isopulegol cyclase and which has been selected from the group of microorganisms consisting of the genera *Escherichia*, *Corynebacterium*, *Ralstonia*, *Clostridium*, *Pseudomonas*, *Bacillus*, *Zymomonas*, *Rhodobacter*, *Streptomyces*, *Burkholderia*, *Lactobacillus* and *Lactococcus*.

37. The method according to one of embodiments 26 to 36, wherein the enzyme having the activity of a citronellal-isopulegol cyclase has been produced by transgenic microorganisms of the species *Escherichia coli*, *Pseudomonas putida*, *Burkholderia glumae*, *Corynebacterium glutamicum*, *Saccharomyces cerevisiae*. *Pichia pastoris*, *Streptomyces lividans*, *Streptomyces coelicolor*, *Bacillus subtilis* or *Zymomonas mobilis* which overproduce the enzyme having the activity of a citronellal-isopulegol cyclase.

38. Use of an enzyme having the activity of a citronellal-isopulegol cyclase for the biocatalytic conversion of citronellal to isopulegol.

39. Use according to embodiment 38, wherein the enzyme possesses a polypeptide sequence which either
a) is SEQ ID NO: 2, or
b) in which up to 25%, such as, for example, up to 20, 15, 10, 9, 8, 7, 6, 5, 4, 3, 2 or 1% of the amino acid residues are altered relative to SEQ ID NO: 2 by deletion, insertion, substitution or a combination thereof, and which still has at least 50%, such as, for example, at least 60, 65, 70, 75, 80, 85, 90 or 95%, of the enzymatic activity of SEQ ID NO: 2.
40. Use according to embodiment 38 or 39, wherein the enzyme is encoded by a nucleic acid sequence according to SEQ ID NO: 1 or a functional equivalent thereof.
41. Use of a gene construct or vector comprising a nucleic acid sequence according to SEQ ID NO: 1 or a functional equivalent thereof, which encode a polypeptide having the activity of a citronellal-isopulegol cyclase, which serves for the biocatalytic conversion of citronellal to isopulegol, in a method of production of isopulegol by cyclization of citronellal.
42. Use of a host cell which comprises a gene construct or a vector comprising a nucleic acid sequence according to SEQ ID NO: 1 or a functional equivalent thereof, for preparing an enzyme having the activity of a citronellal-isopulegol cyclase for the biocatalytic conversion of citronellal to isopulegol.

C. Further Embodiments of the Invention

1. Especially Suitable Wild-Type Sequences

SHC wild-type sequences usable according to the invention, whose SEQ ID NO, source organism, GenBank reference number, the amino acid residue "corresponding" to position F486 of SEQ ID NO:2, i.e. F486-analog ("Aa") and whose sequence position are presented in the following table. The information is based on a sequence alignment, which was set up as follows:

| Program: | CLUSTALW, |
|---|---|
| Default parameters: | |
| Protein Gap Open Penalty | 10.0 |
| Protein Gap Extension Penalty | 0.2 |
| Protein weight matrix: | Gonnet series |

| S_ID DB | SEQ ID NO | Organism | GI No. of the reference sequences | Aa | Position |
|---|---|---|---|---|---|
| s1 | seq_ID 2 | *Zymomonas mobilis* | AAV90172.1 | F | 486 |
| s20 | seq_ID 3 | *Streptomyces coelicolor* | CAB39697.1 | F | 449 |
| s911 | seq_ID 4 | *Acetobacter pasteurianus* | BAH99456.1 | F | 481 |
| s2 | seq_ID 5 | *Bradyrhizobium* sp. | ABQ33590.1 | F | 447 |
| s940 | seq_ID 6 | *Zymomonas mobilis* | EER62728.1 | F | 438 |
| s949 | seq_ID 7 | *Acidithiobacillus caldus* | EET25937.1 | Y | 432 |
| s167 | seq_ID 8 | *Acidithiobacillus ferrooxidans* | ACH84004.1 | Y | 429 |
| s41 | seq_ID 9 | *Acidobacterium capsulatum* | ACO34244.1 | F | 458 |
| s36 | seq_ID 10 | *Acidothermus cellulolyticus* | ABK53469.1 | F | 426 |
| s83 | seq_ID 11 | *Adiantum capillus-veneris* | BAF93209.1 | Y | 436 |
| s143 | seq_ID 12 | *Ajellomyces capsulatus* | EDN09769.1 | F | 496 |
| s995 | seq_ID 13 | *Ajellomyces capsulatus* | EER40510.1 | — | 432 |
| s163 | seq_ID 14 | *Ajellomyces capsulatus* | EEH02950.1 | F | 429 |
| s13 | seq_ID 15 | *Alicyclobacillus acidocaldarius* | EED08231.1 | Y | 420 |
| s14 | seq_ID 16 | *Alicyclobacillus acidocaldarius* | P33247.4 | Y | 420 |
| s1193 | seq_ID 17 | *Alicyclobacillus acidocaldarius* | AAT70690.1 | Y | 116 |
| s21 | seq_ID 18 | *Alicyclobacillus acidoterrestris* | CAA61950.1 | Y | 420 |
| s1189 | seq_ID 19 | *Alicyclobacillus acidoterrestris* | AAT70691.1 | Y | 121 |
| s51 | seq_ID 20 | *Anabaena variabilis* | ABA24268.1 | F | 423 |
| s76 | seq_ID 21 | *Anaeromyxobacter* sp. | ABS28257.1 | F | 440 |
| s159 | seq_ID 22 | *Aspergillus clavatus* | EAW07713.1 | F | 446 |
| s131 | seq_ID 23 | *Aspergillus flavus* | EED48353.1 | F | 444 |
| s176 | seq_ID 24 | *Aspergillus fumigatus* | EDP50814.1 | F | 502 |
| s126 | seq_ID 25 | *Aspergillus fumigatus* | EAL84865.1 | F | 449 |
| s178 | seq_ID 26 | *Aspergillus fumigatus* | EAL86291.2 | F | 406 |
| s121 | seq_ID 27 | *Aspergillus niger* | CAK43501.1 | F | 441 |
| s115 | seq_ID 28 | *Aspergillus niger* | CAK45506.1 | F | 440 |
| s124 | seq_ID 29 | *Aspergillus oryzae* | BAE63941.1 | F | 444 |
| s119 | seq_ID 30 | *Azotobacter vinelandii* | EAM07611.1 | F | 442 |
| s223 | seq_ID 31 | *Bacillus amyloliquefaciens* | ABS74269.1 | F | 413 |
| s221 | seq_ID 32 | *Bacillus anthracis* | AAP27368.1 | F | 409 |
| s976 | seq_ID 33 | *Bacillus cereus* | EEK66523.1 | F | 423 |
| s225 | seq_ID 34 | *Bacillus cereus* | EAL12758.1 | F | 423 |
| s972 | seq_ID 35 | *Bacillus cereus* | EEL44583.1 | F | 412 |
| s977 | seq_ID 36 | *Bacillus cereus* | EEK43841.1 | F | 412 |
| s985 | seq_ID 37 | *Bacillus cereus* | EEK82938.1 | F | 412 |
| s988 | seq_ID 38 | *Bacillus cereus* | EEK99528.1 | F | 412 |
| s981 | seq_ID 39 | *Bacillus cereus* | EEK77935.1 | F | 412 |
| s987 | seq_ID 40 | *Bacillus cereus* | EEL81079.1 | F | 412 |
| s960 | seq_ID 41 | *Bacillus cereus* | EEK88307.1 | F | 412 |
| S979 | seq_ID 42 | *Bacillus cereus* | EEL63943.1 | F | 412 |
| s974 | seq_ID 43 | *Bacillus cereus* | EEL59884.1 | F | 412 |
| s956 | seq_ID 44 | *Bacillus cereus* | EEL69857.1 | F | 412 |
| s951 | seq_ID 45 | *Bacillus cereus* | EEL92663.1 | F | 412 |
| s986 | seq_ID 46 | *Bacillus cereus* | EEL49968.1 | F | 411 |
| s227 | seq_ID 47 | *Bacillus cereus* | AAU16998.1 | F | 409 |
| s224 | seq_ID 48 | *Bacillus cereus* | AAS42477.1 | F | 409 |
| s212 | seq_ID 49 | *Bacillus cereus* | ACK95843.1 | F | 409 |
| s289 | seq_ID 50 | *Bacillus coahuilensis* | 205373680 | F | 276 |

-continued

| | | | | | |
|---|---|---|---|---|---|
| s219 | seq_ID 51 | *Bacillus cytotaxicus* | ABS22481.1 | F | 411 |
| s230 | seq_ID 52 | *Bacillus licheniformis* | AAU23777.1 | F | 414 |
| s955 | seq_ID 53 | *Bacillus mycoides* | EEL98438.1 | F | 412 |
| s990 | seq_ID 54 | *Bacillus mycoides* | EEM04821.1 | F | 411 |
| s989 | seq_ID 55 | *Bacillus pseudomycoides* | EEM16144.1 | F | 411 |
| s247 | seq_ID 56 | *Bacillus pumilus* | ABV62529.1 | F | 409 |
| s250 | seq_ID 57 | *Bacillus pumilus* | EDW21137.1 | F | 409 |
| s249 | seq_ID 58 | *Bacillus* sp. | EAR64404.1 | F | 425 |
| s218 | seq_ID 59 | *Bacillus* sp. | EDL66148.1 | F | 412 |
| s241 | seq_ID 60 | *Bacillus subtilis* | Q796C3.1 | F | 415 |
| s284 | seq_ID 61 | *Bacillus subtilis* | AAB84441.1 | F | 415 |
| s215 | seq_ID 62 | *Bacillus thuringiensis* | ABK86448.1 | F | 423 |
| s984 | seq_ID 63 | *Bacillus thuringiensis* | EEM21409.1 | F | 412 |
| s957 | seq_ID 64 | *Bacillus thuringiensis* | EEM82653.1 | F | 412 |
| s980 | seq_ID 65 | *Bacillus thuringiensis* | EEM52372.1 | F | 412 |
| s961 | seq_ID 66 | *Bacillus thuringiensis* | EEM27851.1 | F | 412 |
| s969 | seq_ID 67 | *Bacillus thuringiensis* | EEM40716.1 | F | 412 |
| s959 | seq_ID 68 | *Bacillus thuringiensis* | EEM46814.1 | F | 409 |
| s965 | seq_ID 69 | *Bacillus thuringiensis* | EEM94969.1 | F | 409 |
| s202 | seq_ID 70 | *Bacillus weihenstephanensis* | ABY44436.1 | F | 409 |
| s63 | seq_ID 71 | Bacterium Ellin514 | EEF57225.1 | F | 461 |
| s72 | seq_ID 72 | Bacterium Ellin514 | EEF59508.1 | Y | 435 |
| s87 | seq_ID 73 | *Beijerinckia indica* | ACB96717.1 | F | 441 |
| s69 | seq_ID 74 | *Blastopirellula marina* | EAQ81955.1 | F | 475 |
| s543 | seq_ID 75 | *Blastopirellula marina* | EAQ78122.1 | F | 389 |
| s156 | seq_ID 76 | *Bradyrhizobium japonicum* | CAA60250.1 | F | 439 |
| s938 | seq_ID 77 | *Acetobacter pasteurianus* | BAH98349.1 | F | 437 |
| s3 | seq_ID 78 | *Bradyrhizobium* sp. | CAL79893.1 | F | 447 |
| s201 | seq_ID 79 | *Brevibacillus brevis* | BAH44778.1 | F | 448 |
| s148 | seq_ID 80 | *Burkholderia ambifaria* | EDT05097.1 | F | 450 |
| s158 | seq_ID 81 | *Burkholderia ambifaria* | EDT37649.1 | F | 450 |
| s149 | seq_ID 82 | *Burkholderia ambifaria* | ACB68303.1 | F | 446 |
| s100 | seq_ID 83 | *Burkholderia ambifaria* | EDT42454.1 | F | 436 |
| s146 | seq_ID 84 | *Burkholderia cenocepacia* | EAY66961.1 | F | 451 |
| s139 | seq_ID 85 | *Burkholderia cenocepacia* | ACA95661.1 | F | 451 |
| s147 | seq_ID 86 | *Burkholderia cenocepacia* | CAR57099.1 | F | 451 |
| s95 | seq_ID 87 | *Burkholderia cenocepacia* | CAR56694.1 | F | 436 |
| s102 | seq_ID 88 | *Burkholderia dolosa* | EAY71311.1 | F | 437 |
| s941 | seq_ID 89 | *Burkholderia glumae* | ACR32572.1 | F | 555 |
| s945 | seq_ID 90 | *Burkholderia glumae* | ACR30752.1 | F | 449 |
| s132 | seq_ID 91 | *Burkholderia graminis* | EDT12320.1 | F | 462 |
| s104 | seq_ID 92 | *Burkholderia mallei* | ABM48844.1 | F | 436 |
| s140 | seq_ID 93 | *Burkholderia multivorans* | ABX19650.1 | F | 450 |
| s116 | seq_ID 94 | *Burkholderia multivorans* | ABX16859.1 | F | 436 |
| s91 | seq_ID 95 | *Burkholderia oklahomensis* | 167567074 | F | 447 |
| s111 | seq_ID 96 | *Burkholderia phymatum* | ACC73258.1 | F | 456 |
| s127 | seq_ID 97 | *Burkholderia phytofirmans* | ACD21317.1 | F | 455 |
| s120 | seq_ID 98 | *Burkholderia pseudamallei* | EEC32728.1 | F | 436 |
| s137 | seq_ID 99 | *Burkholderia* sp. | EEA03553.1 | F | 460 |
| s144 | seq_ID 100 | *Burkholderia* sp. | ABB06563.1 | F | 450 |
| s98 | seq_ID 101 | *Burkholderia* sp. | ABB10136.1 | F | 436 |
| s944 | seq_ID 102 | *Burkholderia* sp. CCGE1002 | EFA54357.1 | F | 473 |
| s89 | seq_ID 103 | *Burkholderia thailandensis* | 167840988 | F | 451 |
| s113 | seq_ID 104 | *Burkholderia thailandensis* | 167617352 | F | 442 |
| s154 | seq_ID 105 | *Burkholderia ubonensis* | 167589807 | F | 445 |
| s93 | seq_ID 106 | *Burkholderia ubonensis* | 167584986 | F | 436 |
| s96 | seq_ID 107 | *Burkholderia vietnamiensis* | ABO56791.1 | F | 436 |
| s150 | seq_ID 108 | *Burkholderia xenovorans* | ABE35912.1 | F | 457 |
| s54 | seq_ID 109 | *Candidatus Koribacter* | ABF40741.1 | F | 435 |
| s171 | seq_ID 110 | *Candidatus Kuenenia* | CAJ71215.1 | F | 273 |
| s79 | seq_ID 111 | *Candidatus Solibacter* | ABJ82180.1 | F | 439 |
| s99 | seq_ID 112 | *Candidatus Solibacter* | ABJ82254.1 | F | 429 |
| s917 | seq_ID 113 | *Catenulispora acidiphila* | ACU75510.1 | F | 418 |
| s65 | seq_ID 114 | *Chthoniobacter flavus* | EDY15838.1 | F | 433 |
| s637 | seq_ID 115 | *Chthoniobacter flavus* | EDY22035.1 | F | 384 |
| s38 | seq_ID 116 | *Crocosphaera watsonii* | EAM53094.1 | F | 426 |
| s186 | seq_ID 117 | *Cupriavidus taiwanensis* | CAQ72562.1 | F | 454 |
| s32 | seq_ID 118 | *Cyanothece* sp. | ACB53858.1 | F | 441 |
| s40 | seq_ID 119 | *Cyanothece* sp. | ACK71719.1 | F | 430 |
| s30 | seq_ID 120 | *Cyanothece* sp. | EDY02410.1 | F | 429 |
| s29 | seq_ID 121 | *Cyanothece* sp. | ACK66841.1 | F | 429 |
| s47 | seq_ID 122 | *Cyanothece* sp. | EDX97382.1 | F | 428 |
| s35 | seq_ID 123 | *Cyanothece* sp. | EAZ91809.1 | F | 426 |
| s39 | seq_ID 124 | *Cyanothece* sp. | ACL45896.1 | F | 423 |
| s925 | seq_ID 125 | *Cyanothece* sp. PCC 8802 | ACV02092.1 | F | 429 |
| s64 | seq_ID 126 | *Desulfovibrio salexigens* | EEC62384.1 | F | 475 |
| s74 | seq_ID 127 | *Dryopteris crossirhizoma* | BAG68223.1 | F | 444 |
| s59 | seq_ID 128 | *Frankia alni* | CAJ61140.1 | Y | 533 |
| s48 | seq_ID 129 | *Frankia alni* | CAJ60090.1 | F | 493 |

-continued

| | | | | | |
|---|---|---|---|---|---|
| s56 | seq_ID 130 | *Frankia* sp. | ABD10207.1 | F | 530 |
| s60 | seq_ID 131 | *Frankia* sp. | ABW15063.1 | F | 512 |
| s31 | seq_ID 132 | *Frankia* sp. | ABW14125.1 | Y | 481 |
| s948 | seq_ID 133 | *Frankia* sp. Eul1c | EFA59873.1 | F | 557 |
| s919 | seq_ID 134 | *Frankia* sp. Eul1c | EFA59089.1 | F | 553 |
| s628 | seq_ID 135 | *Gemmata obscuriglobus* | 168700710 | F | 387 |
| s209 | seq_ID 136 | *Geobacillus* sp. | EED61885.1 | F | 404 |
| s206 | seq_ID 137 | *Geobacillus* sp. | EDY05760.1 | F | 403 |
| s964 | seq_ID 138 | *Geobacillus* sp. Y412MC52 | EEN95021.1 | F | 404 |
| s993 | seq_ID 139 | *Geobacillus* sp. Y412MC61 | ACX79399.1 | F | 404 |
| s205 | seq_ID 140 | *Geobacillus thermodenitrificans* | ABO67242.1 | F | 403 |
| s15 | seq_ID 141 | *Geobacter bemidjiensis* | ACH40355.1 | F | 468 |
| s8 | seq_ID 142 | *Geobacter lovleyi* | ACD95949.1 | F | 470 |
| s62 | seq_ID 143 | *Geobacter metallireducens* | ABB30662.1 | F | 493 |
| s12 | seq_ID 144 | *Geobacter metallireducens* | ABB33038.1 | F | 467 |
| s73 | seq_ID 145 | *Geobacter* sp. | ACM21577.1 | F | 487 |
| s10 | seq_ID 146 | *Geobacter* sp. | EDV72707.1 | F | 468 |
| s11 | seq_ID 147 | *Geobacter* sp. | ACM22003.1 | F | 467 |
| s913 | seq_ID 148 | *Geobacter* sp. M18 | EET34621.1 | F | 468 |
| s914 | seq_ID 149 | *Geobacter* sp. M21 | ACT16952.1 | F | 468 |
| s58 | seq_ID 150 | *Geobacter sulfurreducens* | AAR36453.1 | F | 493 |
| s7 | seq_ID 151 | *Geobacter sulfurreducens* | AAR34018.1 | F | 467 |
| s9 | seq_ID 152 | *Geobacter uraniireducens* | ABQ25226.1 | F | 467 |
| s46 | seq_ID 153 | *Gloeobacter violaceus* | BAC91998.1 | F | 425 |
| s67 | seq_ID 154 | *Gluconacetobacter diazotrophicus* | ACI51585.1 | F | 444 |
| s165 | seq_ID 155 | *Gluconacetobacter diazotrophicus* | CAP55563.1 | F | 444 |
| s68 | seq_ID 156 | *Gluconobacter oxydans* | AAW61994.1 | F | 445 |
| s80 | seq_ID 157 | *Granulibacter bethesdensis* | ABI63005.1 | F | 429 |
| s937 | seq_ID 158 | *Hyphomicrobium denitrificans* | EET65847.1 | F | 444 |
| s932 | seq_ID 159 | *Leptospirillum ferrodiazotrophum* | EES53667.1 | F | 460 |
| s24 | seq_ID 160 | *Leptospirillum rubarum* | EAY57382.1 | F | 448 |
| s25 | seq_ID 161 | *Leptospirillum* sp. | EDZ38599.1 | F | 448 |
| s174 | seq_ID 162 | *Magnaporthe grisea* | EDK02551.1 | F | 445 |
| s153 | seq_ID 163 | *Magnetospirillum magnetotacticum* | 46203107 | F | 447 |
| s49 | seq_ID 164 | *Methylacidiphilum infernorum* | ACD82457.1 | F | 456 |
| s169 | seq_ID 165 | *Methylobacterium chloromethanicum* | ACK83067.1 | F | 447 |
| s75 | seq_ID 166 | *Methylobacterium chloromethanicum* | ACK38232.1 | F | 426 |
| s946 | seq_ID 167 | *Methylobacterium extorquens* | CAX24364.1 | F | 447 |
| s141 | seq_ID 168 | *Methylobacterium nodulans* | ACL61886.1 | F | 442 |
| s152 | seq_ID 169 | *Methylobacterium populi* | ACB79998.1 | F | 447 |
| s162 | seq_ID 170 | *Methylobacterium radiotolerans* | ACB27373.1 | F | 445 |
| s180 | seq_ID 171 | *Methylobacterium* sp. | ACA20611.1 | F | 442 |
| s175 | seq_ID 172 | *Methylocella silvestris* | ACK52150.1 | F | 451 |
| s181 | seq_ID 173 | *Methylococcus capsulatus* | CAA71098.1 | F | 439 |
| s55 | seq_ID 174 | *Microcystis aeruginosa* | CAO86472.1 | F | 423 |
| s101 | seq_ID 175 | *Neosartorya fischeri* | EAW20752.1 | F | 448 |
| s129 | seq_ID 176 | *Nitrobacter hamburgensis* | ABE63461.1 | F | 433 |
| s161 | seq_ID 177 | *Nitrobacter* sp. | EAQ34404.1 | F | 430 |
| s160 | seq_ID 178 | *Nitrobacter winogradskyi* | ABA05523.1 | F | 433 |
| s157 | seq_ID 179 | *Nitrococcus mobilis* | EAR22397.1 | F | 436 |
| s164 | seq_ID 180 | *Nitrosococcus oceani* | ABA57818.1 | F | 446 |
| s170 | seq_ID 181 | *Nitrosomonas europaea* | CAD85079.1 | F | 452 |
| s173 | seq_ID 182 | *Nitrosomonas eutropha* | ABI59752.1 | F | 456 |
| s943 | seq_ID 183 | *Nitrosomonas* sp. AL212 | EET32702.1 | F | 452 |
| s142 | seq_ID 184 | *Nitrosospira multiformis* | ABB75845.1 | F | 439 |
| s52 | seq_ID 185 | *Nostoc punctiforme* | ACC84529.1 | F | 423 |
| s45 | seq_ID 186 | *Nostoc* sp. | BAB72732.1 | F | 423 |
| s122 | seq_ID 187 | *Oligotropha carboxidovorans* | ACI93782.1 | F | 433 |
| s233 | seq_ID 188 | *Paenibacillus* sp. | EDS49994.1 | F | 399 |
| s991 | seq_ID 189 | *Paenibacillus* sp. JDR-2 | ACS99948.1 | F | 399 |
| s950 | seq_ID 190 | *Paenibacillus* sp. oral taxon 786 | EES74793.1 | F | 428 |
| s1280 | seq_ID 191 | *Paramecium tetraurelia* | 145542269 | F | 400 |
| s71 | seq_ID 192 | *Pelobacter carbinolicus* | ABA87701.1 | F | 494 |
| s5 | seq_ID 193 | *Pelobacter carbinolicus* | ABA87615.1 | F | 435 |
| s66 | seq_ID 194 | *Pelobacter propionicus* | ABK98395.1 | F | 486 |
| s16 | seq_ID 195 | *Pelobacter propionicus* | ABK98811.1 | F | 467 |
| s136 | seq_ID 196 | *Penicillium chrysogenum* | CAP99707.1 | F | 440 |
| s936 | seq_ID 197 | *Planctomyces limnophilus* | EEO67214.1 | F | 490 |
| s1158 | seq_ID 198 | *Planctomyces limnophilus* | EEO68341.1 | F | 412 |
| s526 | seq_ID 199 | *Planctomyces maris* | EDL58855.1 | F | 392 |
| s992 | seq_ID 200 | *Polypodiodes niponica* | BAI48071.1 | Y | 521 |
| s942 | seq_ID 201 | *Polypodiodes niponica* | BAI48070.1 | F | 443 |
| s1202 | seq_ID 202 | *Populus trichocarpa* | EEF12098.1 | F | 162 |
| s168 | seq_ID 203 | *Ralstonia eutropha* | AAZ64302.1 | F | 452 |
| s190 | seq_ID 204 | *Ralstonia eutropha* | CAJ96989.1 | F | 451 |
| s81 | seq_ID 205 | *Ralstonia metallidurans* | ABF11015.1 | F | 448 |
| s110 | seq_ID 206 | *Ralstonia metallidurans* | ABF11268.1 | F | 430 |
| s123 | seq_ID 207 | *Rhizobium* sp. | P55348.1 | F | 433 |
| s657 | seq_ID 208 | *Rhodopirellula baltica* | CAD74517.1 | F | 428 |

-continued

| | | | | | |
|---|---|---|---|---|---|
| s4 | seq_ID 209 | *Rhodopseudomonas palustris* | ABJ08391.1 | F | 445 |
| s130 | seq_ID 210 | *Rhodopseudomonas palustris* | CAA71101.1 | F | 433 |
| s155 | seq_ID 211 | *Rhodopseudomonas palustris* | ABD06434.1 | F | 433 |
| s97 | seq_ID 212 | *Rhodopseudomonas palustris* | ABD87279.1 | F | 433 |
| s135 | seq_ID 213 | *Rhodopseudomonas palustris* | ACF02757.1 | F | 432 |
| s84 | seq_ID 214 | *Rhodospirillum rubrum* | ABC20867.1 | F | 437 |
| s1279 | seq_ID 215 | *Rubrobacter xylanophilus* | ABG05671.1 | F | 372 |
| s915 | seq_ID 216 | *Saccharomonospora viridis* | ACU97316.1 | F | 428 |
| s42 | seq_ID 217 | *Saccharopolyspora erythraea* | CAM03596.1 | F | 421 |
| s82 | seq_ID 218 | *Schizosaccharomyces japonicus* | EEB08219.1 | F | 437 |
| s923 | seq_ID 219 | *Sphaerobacter thermophilus* | ACZ39437.1 | F | 404 |
| s924 | seq_ID 220 | *Streptomyces albus* | 239983547 | F | 371 |
| s23 | seq_ID 221 | *Streptomyces avermitilis* | BAC69361.1 | F | 450 |
| s44 | seq_ID 222 | *Acaryochloris marina* | ABW29816.1 | F | 423 |
| s921 | seq_ID 223 | *Streptomyces filamentosus* | 239945642 | F | 447 |
| s934 | seq_ID 224 | *Streptomyces flavogriseus* | EEW70811.1 | F | 447 |
| s920 | seq_ID 225 | *Streptomyces ghanaensis* | 239927462 | F | 448 |
| s922 | seq_ID 226 | *Streptomyces griseoflavus* | 256812310 | F | 448 |
| s28 | seq_ID 227 | *Streptomyces griseus* | BAG17791.1 | F | 447 |
| s926 | seq_ID 228 | *Streptomyces hygroscopicus* | 256775136 | F | 414 |
| s916 | seq_ID 229 | *Streptomyces lividans* | 256783789 | F | 449 |
| s33 | seq_ID 230 | *Streptomyces peucetius* | ACA52082.1 | F | 455 |
| s27 | seq_ID 231 | *Streptomyces pristinaespiralis* | EDY61772.1 | F | 455 |
| s933 | seq_ID 232 | *Streptomyces scabiei* | CBG68454.1 | F | 447 |
| s37 | seq_ID 233 | *Streptomyces* sp. | EDX25760.1 | F | 453 |
| s34 | seq_ID 234 | *Streptomyces* sp. | EDY46371.1 | F | 453 |
| s931 | seq_ID 235 | *Streptomyces* sp. AA4 | 256668250 | F | 428 |
| s918 | seq_ID 236 | *Streptomyces* sp. C | 256770952 | F | 454 |
| s929 | seq_ID 237 | *Streptomyces* sp. Mg1 | 254385931 | F | 453 |
| s928 | seq_ID 238 | *Streptomyces* sp. SPB74 | 254379682 | F | 453 |
| s930 | seq_ID 239 | *Streptomyces* sp. SPB78 | 256680470 | F | 404 |
| s26 | seq_ID 240 | *Streptomyces sviceus* | EDY55942.1 | F | 453 |
| s927 | seq_ID 241 | *Streptomyces viridochromogenes* | 256805984 | F | 447 |
| s61 | seq_ID 242 | *Synechococcus* sp. | EDX84551.1 | F | 426 |
| s935 | seq_ID 243 | *Synechococcus* sp. PCC 7335 | 254422098 | F | 426 |
| s53 | seq_ID 244 | *Synechocystis* sp. | BAA17978.1 | F | 428 |
| s22 | seq_ID 245 | *Syntrophobacter fumaroxidans* | ABK18414.1 | F | 478 |
| s6 | seq_ID 246 | *Syntrophobacter fumaroxidans* | ABK17672.1 | F | 457 |
| s912 | seq_ID 247 | *Teredinibacter turnerae* | ACR13362.1 | F | 438 |
| s57 | seq_ID 248 | *Thermosynechococcus elongatus* | BAC09861.1 | F | 425 |
| s43 | seq_ID 249 | *Trichodesmium erythraeum* | ABG50159.1 | F | 418 |
| s1178 | seq_ID 250 | Uncultured organism | ACA58560.1 | F | 118 |
| s1176 | seq_ID 251 | Uncultured organism | ABL07557.1 | F | 118 |
| s1165 | seq_ID 252 | Uncultured organism | ACA58559.1 | F | 116 |
| s1166 | seq_ID 253 | Uncultured organism | ACA58558.1 | F | 116 |
| s1168 | seq_ID 254 | Uncultured organism | ABL07560.1 | F | 116 |
| s1169 | seq_ID 255 | Uncultured organism | ABL07565.1 | F | 116 |
| s1170 | seq_ID 256 | Uncultured organism | ABL07566.1 | F | 116 |
| s1167 | seq_ID 257 | Uncultured organism | ACA58545.1 | F | 116 |
| s1171 | seq_ID 258 | Uncultured organism | ACA58535.1 | F | 116 |
| s1180 | seq_ID 259 | Uncultured organism | ACA58549.1 | F | 116 |
| s1179 | seq_ID 260 | Uncultured organism | ACA58554.1 | F | 116 |
| s1181 | seq_ID 261 | Uncultured organism | ACA58555.1 | F | 116 |
| s1182 | seq_ID 262 | Uncultured organism | ACA58556.1 | F | 116 |
| s1235 | seq_ID 263 | Uncultured organism | ACA58530.1 | F | 116 |
| s1188 | seq_ID 264 | Uncultured organism | ACA58534.1 | F | 115 |
| s1237 | seq_ID 265 | Uncultured organism | ACA58552.1 | F | 115 |
| s1223 | seq_ID 266 | Uncultured organism | ABL07558.1 | F | 115 |
| s1200 | seq_ID 267 | Uncultured organism | ABL07542.1 | F | 115 |
| s1236 | seq_ID 268 | Uncultured organism | ACA58539.1 | F | 114 |
| s1238 | seq_ID 269 | Uncultured organism | ACA58537.1 | F | 114 |
| s1233 | seq_ID 270 | Uncultured organism | ACA58543.1 | F | 114 |
| s1173 | seq_ID 271 | Uncultured organism | ABL07553.1 | F | 114 |
| s1241 | seq_ID 272 | Uncultured organism | ABL07540.1 | F | 114 |
| s1242 | seq_ID 273 | Uncultured organism | ABL07544.1 | F | 114 |
| s1225 | seq_ID 274 | Uncultured organism | ACA58557.1 | F | 114 |
| s1183 | seq_ID 275 | Uncultured organism | ACA58520.1 | F | 113 |
| s1197 | seq_ID 276 | Uncultured organism | ACA58524.1 | F | 113 |
| s1185 | seq_ID 277 | Uncultured organism | ACA58522.1 | F | 113 |
| s1190 | seq_ID 278 | Uncultured organism | ACA58525.1 | F | 113 |
| s1187 | seq_ID 279 | Uncultured organism | ACA58523.1 | F | 113 |
| s1184 | seq_ID 280 | Uncultured organism | ACA58521.1 | F | 113 |
| s1204 | seq_ID 281 | Uncultured organism | ACA58547.1 | F | 113 |
| s1221 | seq_ID 282 | Uncultured organism | ACA58544.1 | F | 113 |
| s1198 | seq_ID 283 | Uncultured organism | ACA58546.1 | F | 112 |
| s1226 | seq_ID 284 | Uncultured organism | ACA58527.1 | F | 112 |
| s1227 | seq_ID 285 | Uncultured organism | ABL07537.1 | F | 112 |
| s1232 | seq_ID 286 | Uncultured organism | ACA58510.1 | F | 112 |
| s1230 | seq_ID 287 | Uncultured organism | ACA58538.1 | F | 112 |

-continued

| | | | | | |
|---|---|---|---|---|---|
| s1229 | seq_ID 288 | Uncultured organism | ACA58542.1 | F | 112 |
| s1231 | seq_ID 289 | Uncultured organism | ACA58540.1 | F | 112 |
| s1207 | seq_ID 290 | Uncultured organism | ABL07564.1 | F | 112 |
| s1212 | seq_ID 291 | Uncultured organism | ABL07563.1 | F | 112 |
| s1208 | seq_ID 292 | Uncultured organism | ABL07562.1 | F | 112 |
| s1209 | seq_ID 293 | Uncultured organism | ABL07559.1 | F | 112 |
| s1214 | seq_ID 294 | Uncultured organism | ABL07556.1 | F | 112 |
| s1216 | seq_ID 295 | Uncultured organism | ACA58528.1 | F | 112 |
| s1219 | seq_ID 296 | Uncultured organism | ACA58536.1 | F | 112 |
| s1192 | seq_ID 297 | Uncultured organism | ABL07533.1 | F | 112 |
| s1195 | seq_ID 298 | Uncultured organism | ABL07536.1 | F | 112 |
| s1174 | seq_ID 299 | Uncultured organism | ABL07545.1 | F | 112 |
| s1186 | seq_ID 300 | Uncultured organism | ABL07548.1 | F | 112 |
| s1196 | seq_ID 301 | Uncultured organism | ACA58561.1 | F | 112 |
| s1172 | seq_ID 302 | Uncultured organism | ABL07555.1 | F | 112 |
| s1194 | seq_ID 303 | Uncultured organism | ABL07541.1 | F | 112 |
| s1211 | seq_ID 304 | Uncultured organism | ABL07554.1 | F | 112 |
| s1220 | seq_ID 305 | Uncultured organism | ABL07547.1 | F | 112 |
| s1203 | seq_ID 306 | Uncultured organism | ABL07550.1 | F | 112 |
| s1199 | seq_ID 307 | Uncultured organism | ABL07551.1 | F | 112 |
| s1228 | seq_ID 308 | Uncultured organism | ACA58509.1 | F | 111 |
| s1201 | seq_ID 309 | Uncultured organism | ACA58514.1 | F | 111 |
| s1205 | seq_ID 310 | Uncultured organism | ABL07543.1 | F | 111 |
| s1206 | seq_ID 311 | Uncultured organism | ABL07534.1 | F | 111 |
| s1177 | seq_ID 312 | Uncultured organism | ABL07546.1 | F | 111 |
| s1210 | seq_ID 313 | Uncultured organism | ABL07535.1 | F | 111 |
| s1175 | seq_ID 314 | Uncultured organism | ABL07552.1 | F | 111 |
| s1191 | seq_ID 315 | Uncultured organism | ABL07549.1 | F | 111 |
| s1222 | seq_ID 316 | Uncultured organism | ACA58553.1 | F | 111 |
| s1244 | seq_ID 317 | Uncultured organism | ABL07539.1 | F | 111 |
| s1213 | seq_ID 318 | Uncultured organism | ACA58532.1 | F | 110 |
| s1239 | seq_ID 319 | Uncultured organism | ACA58548.1 | F | 110 |
| s1215 | seq_ID 320 | Uncultured organism | ABL07561.1 | F | 110 |
| s1240 | seq_ID 321 | Uncultured organism | ACA58533.1 | F | 110 |
| s1234 | seq_ID 322 | Uncultured organism | ABL07538.1 | F | 109 |
| s1224 | seq_ID 323 | Uncultured organism | ACA58541.1 | F | 109 |
| s1217 | seq_ID 324 | Uncultured organism | ACA58529.1 | F | 109 |
| s596 | seq_ID 325 | *Verrucomicrobium spinosum* | 171910093 | F | 395 |
| s70 | seq_ID 326 | *Acidiphilium cryptum* | ABQ30890.1 | F | 430 |

Further potential cyclase mutants with the desired substrate properties can be produced starting from these, on the basis of the findings for mutants of Zm-SHC-1.

2. Further Proteins/Enzyme Mutants According to the Invention

The present invention is not limited to the mutants with cyclase activity concretely disclosed herein, but rather also extends to functional equivalents thereof.

"Functional equivalents" or analogs of the concretely disclosed enzymes and enzyme mutants (F486 and "F486-analog" mutants, derived from SEQ ID NO: 2 to 326, in particular SEQ ID NO: 2 to 6) are, within the scope of the present invention, various polypeptides thereof, which furthermore possess the desired biological activity, for example cyclase activity.

For example "functional equivalents" are understood to include enzymes and mutants that have, in a test applied for "cyclase activity" in the sense of the invention (i.e. with a reference substrate under standard conditions), an at least 1%, in particular at least about 5 to 10%, for example at least 10% or at least 20%, for example at least 50% or 75% or 90% higher or lower activity of an enzyme, comprising an amino acid sequence concretely defined herein (e.g. an F486 and "F486-analog" mutant, derived from SEQ ID NO: 2 to 326; in particular SEQ ID NO: 2 to 6).

The activity information for functional equivalents refers herein, unless stated otherwise, to activity determinations, performed by means of a reference substrate under standard conditions, as defined herein.

The "cyclase activity" in the sense of the invention can be detected by means of various known tests. Without being limited to this, we may mention a test using a reference substrate, for example citronellal racemate or R(+) form, under standard conditions, as described above and explained in the experimental section.

Functional equivalents are moreover stable e.g. between pH 4 to 11 and advantageously possess a pH optimum in a range from pH 5 to 10, such as in particular 6.5 to 9.5 or 7 to 8 or at about 7.5, and a temperature optimum in the range from 15° C. to 80° C. or 20° C. to 70° C., for example about 30 to 60° C. or about 35 to 45° C., such as at 40° C.

"Functional equivalents" are to be understood according to the invention to include in particular also "mutants", which, as well as the concretely stated mutation(s) (e.g. an F486 and "F486-analog" mutant, derived from SEQ ID NO: 2 to 326, in particular SEQ ID NO: 2 to 6), have in at least one sequence position of the aforementioned amino acid sequences, an amino acid other than that concretely stated, but nevertheless possess one of the aforementioned biological activities.

"Functional equivalents" comprise the mutants obtainable by one or more, for example 1 to 50, 2 to 30, 2 to 15, 4 to 12 or 5 to 10 "additional mutations", such as amino acid additions, substitutions, deletions and/or inversions, wherein the stated changes can occur in any sequence position, provided they lead to a mutant with the property profile according to the invention. Functional equivalence is in particular also present when the reactivity profiles between mutant and unaltered polypeptide coincide qualitatively, i.e. for example the same substrates are converted at a different rate.

"Additional mutations" of this kind occur at a position of the respective amino acid sequence different from position F486 according to SEQ ID NO: 2 or from the F486-analog position according to one of SEQ ID NOs: 3 to 326, in particular SEQ ID NO: 3 to 6.

Nonlimiting examples of suitable amino acid substitutions are given in the following table:

| Original residue | Examples of substitution |
|---|---|
| Ala | Ser |
| Arg | Lys |
| Asn | Gln; His |
| Asp | Glu |
| Cys | Ser |
| Gln | Asn |
| Glu | Asp |
| Gly | Pro |
| His | Asn; Gln |
| Ile | Leu; Val |
| Leu | Ile; Val |
| Lys | Arg; Gln; Glu |
| Met | Leu; Ile |
| Phe | Met; Leu; Tyr |
| Ser | Thr |
| Thr | Ser |
| Trp | Tyr |
| Tyr | Trp; Phe |
| Val | Ile; Leu |

"Functional equivalents" in the above sense are also "precursors" of the polypeptides described as well as "functional derivatives" and "salts" of the polypeptides.

"Precursors" are natural or synthetic precursors of the polypeptides with or without the desired biological activity.

The term "salts" means both salts of carboxyl groups and salts of acid addition of amino groups of the protein molecules according to the invention. Salts of carboxyl groups can be produced in a manner known per se and comprise inorganic salts, for example sodium, calcium, ammonium, iron and zinc salts, and salts with organic bases, for example amines, such as triethanolamine, arginine, lysine, piperidine and the like. Salts of acid addition, for example salts with mineral acids, such as hydrochloric acid or sulfuric acid and salts with organic acids, such as acetic acid and oxalic acid, are also objects of the invention.

"Functional derivatives" of polypeptides according to the invention can also be produced on functional amino acid side groups or at their N- or C-terminal end by known techniques. Derivatives of this kind comprise for example aliphatic esters of carboxylic acid groups, amides of carboxylic acid groups, obtainable by reaction with ammonia or with a primary or secondary amine; N-acyl derivatives of free amino groups, produced by reaction with acyl groups; or O-acyl derivatives of free hydroxyl groups, produced by reaction with acyl groups.

"Functional equivalents" naturally also comprise polypeptides that are accessible from other organisms, and naturally occurring variants. For example areas of homologous sequence regions can be established by sequence comparison and equivalent enzymes can be determined based on the concrete information of the invention.

"Functional equivalents" also comprise fragments, preferably individual domains or sequence motifs, of the polypeptides according to the invention, which for example have the desired biological function.

"Functional equivalents" are moreover fusion proteins, which have one of the aforementioned polypeptide sequences or functional equivalents derived therefrom and at least one further, functionally different therefrom, heterologous sequence in functional N- or C-terminal linkage (i.e. without mutual substantial functional impairment of the fusion protein parts). Nonlimiting examples of heterologous sequences of this kind are e.g. signal peptides, histidine anchors or enzymes.

"Functional equivalents" that are also included according to the invention are homologs to the concretely disclosed proteins. These possess at least 60%, preferably at least 75%, especially at least 85%, for example 90, 91, 92, 93, 94, 95, 96, 97, 98 or 99%, homology (or identity) to one of the concretely disclosed amino acid sequences, calculated using the algorithm of Pearson and Lipman, Proc. Natl. Acad. Sci. (USA) 85(8), 1988, 2444-2448. A percentage homology or identity of a homologous polypeptide according to the invention means in particular percentage identity of the amino acid residues relative to the total length of one of the amino acid sequences concretely described herein. In particular, however, these homologs also have the F486 or "F486-analog" mutation, derived from SEQ ID NO:2 to 326, in particular SEQ ID NO: 2 to 6.

The percentage identity values can also be determined on the basis of BLAST alignments, blastp algorithms (protein-protein BLAST), or using the Clustal settings given below.

In the case of a possible protein glycosylation, "functional equivalents" according to the invention comprise proteins of the type designated above in deglycosylated or glycosylated form as well as modified forms obtainable by changing the glycosylation pattern.

Homologs of the proteins or polypeptides according to the invention can be produced by mutagenesis, e.g. by point mutation, lengthening or shortening of the protein.

Homologs of the proteins according to the invention can be identified by screening combinatorial databases of mutants, for example shortened mutants. For example a variegated database of protein variants can be produced by combinatorial mutagenesis at nucleic acid level, for example by enzymatic ligation of a mixture of synthetic oligonucleotides. There are a great many methods that can be used for producing databases of potential homologs from a degenerated oligonucleotide sequence. The chemical synthesis of a degenerated gene sequence can be carried out in an automatic DNA synthesizer, and the synthetic gene can then be ligated into a suitable expression vector. The use of a degenerated set of genes makes it possible to provide all sequences, in one mixture, which code for the desired set of potential protein sequences. Methods for the synthesis of degenerated oligonucleotides are known by a person skilled in the art (e.g. Narang, S. A. (1983) Tetrahedron 39:3; Itakura et al. (1984) Annu. Rev. Biochem. 53:323; Itakura et al., (1984) Science 198:1056; Ike et al. (1983) Nucleic Acids Res. 11:477).

Several techniques for screening gene products of combinatorial databases, which were produced by point mutations or shortening, and for screening cDNA databases for gene products with a chosen property, are known in the prior art. These techniques can be adapted for rapid screening of gene banks that have been produced by combinatorial mutagenesis of homologs according to the invention. The techniques used most often for screening large gene banks, as the basis for high-throughput analysis, comprise cloning the gene bank into replicatable expression vectors, transforming suitable cells with the resultant vector bank and expressing the combinatorial genes in conditions in which detection of the desired activity facilitates the isolation of the vector that codes for the gene whose product was detected. Recursive ensemble mutagenesis (REM), a technique that increases the frequency of functional mutants in the databases, can be used in combination with the screening tests, to identify homologs (Arkin and Yourvan (1992) PNAS 89:7811-7815; Delgrave et al. (1993) Protein Engineering 6(3):327-331).

3. Nucleic Acids and Constructs
3.1 Nucleic Adds

The invention also relates to nucleic acid sequences that code for an enzyme as described above or a mutant thereof described above with cyclase activity.

The present invention also relates to nucleic acids with a specified degree of identity to the concrete sequences described herein.

"Identity" between two nucleic acids means identity of the nucleotides in each case over the whole length of nucleic acid, in particular the identity that is calculated by comparison by means of the Vector NTI Suite 7.1 software from the company Informax (USA) using the Clustal method (Higgins D G, Sharp P M. Fast and sensitive multiple sequence alignments on a microcomputer. Comput Appl. Biosci. 1989 April; 5(2): 151-1), setting the following parameters:

Multiple Alignment Parameters:

| | |
|---|---|
| Gap opening penalty | 10 |
| Gap extension penalty | 10 |
| Gap separation penalty range | 8 |
| Gap separation penalty | off |
| % identity for alignment delay | 40 |
| Residue specific gaps | off |
| Hydrophilic residue gap | off |
| Transition weighting | 0 |

Pairwise Alignment Parameter:

| | |
|---|---|
| FAST algorithm | on |
| K-tuple size | 1 |
| Gap penalty | 3 |
| Window size | 5 |
| Number of best diagonals | 5 |

As an alternative, the identity can also be determined according to Chema, Ramu, Sugawara, Hideaki, Koike, Tadashi, Lopez, Rodrigo, Gibson, Toby J, Higgins, Desmond G, Thompson, Julie D. Multiple sequence alignment with the Clustal series of programs. (2003) Nucleic Acids Res 31 (13):3497-500, according to Internet address: ebi.ac.uk/Tools/clustalw/index.html# and with the following parameters:

| | |
|---|---|
| DNA Gap Open Penalty | 15.0 |
| DNA Gap Extension Penalty | 6.66 |
| DNA Matrix | Identity |
| Protein Gap Open Penalty | 10.0 |
| Protein Gap Extension Penalty | 0.2 |
| Protein matrix | Gonnet |
| Protein/DNA ENDGAP | −1 |
| Protein/DNA GAPDIST | 4 |

All nucleic acid sequences mentioned herein (single-stranded and double-stranded DNA and RNA sequences, for example cDNA and mRNA) can be produced in a manner known per se by chemical synthesis from the nucleotide building blocks, for example by fragment condensation of individual overlapping, complementary nucleic acid building blocks of the double helix. The chemical synthesis of oligonucleotides can for example be carried out in a known manner, by the phosphoroamidite technique (Voet. Voet, 2nd edition, Wiley Press New York, pages 896-897). The adding-on of synthetic oligonucleotides and filling of gaps using the Klenow fragment of DNA polymerase and ligation reactions as well as general cloning techniques are described in Sambrook et al. (1989), Molecular Cloning: A Laboratory Manual, Cold Spring Harbor Laboratory Press.

The invention also relates to nucleic acid sequences (single-stranded and double-stranded DNA and RNA sequences, for example cDNA and mRNA), coding for one of the above polypeptides and functional equivalents thereof, which are accessible e.g. using artificial nucleotide analogs.

The invention relates both to isolated nucleic acid molecules, which code for polypeptides or proteins according to the invention or biologically active segments thereof, and to nucleic acid fragments, which can be used for example as hybridization probes or primers for the identification or amplification of coding nucleic acids according to the invention.

The nucleic acid molecules according to the invention can in addition contain untranslated sequences of the 3'- and/or 5'-end of the coding gene region.

The invention further comprises the nucleic acid molecules complementary to the concretely described nucleotide sequences, or a segment thereof.

The nucleotide sequences according to the invention make it possible to produce probes and primers that can be used for the identification and/or cloning of homologous sequences in other cell types and organisms. Said probes or primers usually comprise a nucleotide sequence region which hybridizes under "stringent" conditions (see below) to at least about 12, preferably at least about 25, for example about 40, 50 or 75 successive nucleotides of a sense strand of a nucleic acid sequence according to the invention or of a corresponding antisense strand.

An "isolated" nucleic acid molecule is separate from other nucleic acid molecules that are present in the natural source of the nucleic acid, and moreover can be essentially free of other cellular material or culture medium, when it is produced by recombinant techniques, or free of chemical precursors or other chemicals, when it is chemically synthesized.

A nucleic acid molecule according to the invention can be isolated by standard techniques of molecular biology and the sequence information provided according to the invention. For example, cDNA can be isolated from a suitable cDNA-bank, using one of the concretely disclosed complete sequences or a segment thereof as hybridization probe and standard hybridization techniques (as described for example in Sambrook, Fritsch, E. F. and Maniatis, T. Molecular Cloning: A Laboratory Manual. 2nd edition, Cold Spring Harbor Laboratory, Cold Spring Harbor Laboratory Press, Cold Spring Harbor, N.Y. 1989). Moreover, a nucleic acid molecule, comprising one of the disclosed sequences or a segment thereof, can be isolated by polymerase chain reaction, using the oligonucleotide primers that were constructed on the basis of this sequence. The nucleic acid thus amplified can be cloned into a suitable vector and can be characterized by DNA sequence analysis. The oligonucleotides according to the invention can moreover be produced by standard methods of synthesis, e.g. with an automatic DNA synthesizer.

Nucleic acid sequences according to the invention or derivatives thereof, homologs or parts of these sequences, can be isolated for example with usual hybridization methods or PCR techniques from other bacteria, e.g. via genomic or cDNA databases. These DNA sequences hybridize under standard conditions to the sequences according to the invention.

"Hybridization" means the capacity of a poly- or oligonucleotide to bind to an almost complementary sequence under standard conditions, whereas under these conditions nonspecific binding between noncomplementary partners does not occur. For this, the sequences can be up to 90-100% complementary. The property of complementary sequences of being able to bind specifically to one another is utilized for example in Northern or Southern blotting or in primer binding in PCR or RT-PCR.

Short oligonucleotides of the conserved regions are used advantageously for hybridization. However, longer fragments of the nucleic acids according to the invention or the complete sequences can also be used for hybridization. These standard conditions vary depending on the nucleic acid used (oligonucleotide, longer fragment or complete sequence) or depending on which type of nucleic acid. DNA or RNA, is used for hybridization. Thus, for example, the melting temperatures for DNA:DNA hybrids are approx. 10° C. lower than those of DNA:RNA hybrids of the same length.

Standard conditions mean for example, depending on the nucleic acid, temperatures between 42 and 58° C. in an aqueous buffer solution with a concentration between 0.1 to 5×SSC (1×SSC=0.15 M NaCl, 15 mM sodium citrate, pH 7.2) or additionally in the presence of 50% formamide, for example 42° C. in 5×SSC, 50% formamide. Advantageously, the hybridization conditions for DNA:DNA hybrids are 0.1× SSC and temperatures between about 20° C. to 45° C., preferably between about 30° C. to 45° C. For DNA:RNA hybrids the hybridization conditions are advantageously 0.1×SSC and temperatures between about 30° C. to 55° C., preferably between about 45° C. to 55° C. These stated temperatures for hybridization are for example calculated melting temperature values for a nucleic acid with a length of approx. 100 nucleotides and a G+C content of 50% in the absence of formamide. The experimental conditions for DNA hybridization are described in relevant textbooks on genetics, for example Sambrook et al., "Molecular Cloning", Cold Spring Harbor Laboratory, 1989, and can be calculated using formulas known by a person skilled in the art, for example depending on the length of the nucleic acids, the type of hybrids or the G+C content. Further information on hybridization can be obtained by a person skilled in the art from the following textbooks: Ausubel et al. (eds), 1985, Current Protocols in Molecular Biology, John Wiley & Sons, New York; Hames and Higgins (eds), 1985, Nucleic Acids Hybridization: A Practical Approach, IRL Press at Oxford University Press, Oxford; Brown (ed), 1991, Essential Molecular Biology: A Practical Approach, IRL Press at Oxford University Press, Oxford.

"Hybridization" can in particular take place under stringent conditions. Said hybridization conditions are described for example by Sambrook, J., Fritsch, E. F., Maniatis, T. in: Molecular Cloning (A Laboratory Manual), 2nd edition, Cold Spring Harbor Laboratory Press, 1989, pages 931-9.57 or in Current Protocols in Molecular Biology, John Wiley & Sons, N.Y. (1989), 6.3.1-6.3.6.

"Stringent" hybridization conditions mean in particular: Incubation at 42° C. overnight in a solution consisting of 50% formamide, 5×SSC (750 mM NaCl, 75 mM trisodium citrate), 50 mM sodium phosphate (pH7.6), 5×Denhardt solution, 10% dextran sulfate and 20 g/ml denatured, sheared salmon sperm DNA, followed by a step of washing the filters with 0.1×SSC at 85° C.

The invention also relates to derivatives of the concretely disclosed or derivable nucleic acid sequences.

Thus, further nucleic acid sequences according to the invention coding for cyclase mutants can be derived e.g. from SEQ ID NO: 1 or from the coding sequences for SEQ ID NO: 2 to 326, in particular SEQ ID NO: 2 to 6, by an F486 or F486-analog mutation and differ from them by addition, substitution, insertion or deletion of single or several nucleotides, but furthermore code for polypeptides with the desired property profile.

The invention also includes nucleic acid sequences that comprise so-called silent mutations or are altered corresponding to the codon-usage of a special original or host organism, compared with a concretely stated sequence, as well as naturally occurring variants, for example splice variants or allele variants, thereof.

It also relates to sequences obtainable by conservative nucleotide substitutions (i.e. the amino acid in question is replaced with an amino acid of the same charge, size, polarity and/or solubility).

The invention also relates to the molecules derived by sequence polymorphisms from the concretely disclosed nucleic acids. These genetic polymorphisms can exist between individuals within a population owing to natural variation. These natural variations usually bring about a variance of 1 to 5% in the nucleotide sequence of a gene.

Derivatives of the nucleic acid sequences according to the invention coding for cyclase mutants derived from sequence SEQ ID NO: 1 or from one of the coding sequences for SEQ ID NO: 2 to 326, in particular SEQ ID NO: 2 to 6, include for example allele variants that have at least 60% homology at the derived amino acid level, preferably at least 80% homology, quite especially preferably at least 90% homology over the whole sequence region (regarding homology at the amino acid level, reference should be made to the above account relating to polypeptides). The homologies can advantageously be higher over partial regions of the sequences.

Furthermore, derivatives also mean homologs of the nucleic acid sequences according to the invention, for example fungal or bacterial homologs, shortened sequences, single-strand DNA or RNA of the coding and noncoding DNA sequence.

Moreover, derivatives mean for example fusions with promoters. The promoters, which are added to the given nucleotide sequences, can be altered by at least one nucleotide exchange, at least one insertion, inversion and/or deletion, without the functionality or efficacy of the promoters being impaired. Moreover, the efficacy of the promoters can be increased by altering their sequence or they can be exchanged completely for more effective promoters even of organisms of a different species.

3.2 Generation of Functional Mutants

Furthermore, methods for producing functional mutants of enzymes according to the invention are known by a person skilled in the art.

Depending on the technology used, a person skilled in the art can introduce completely random or even more-directed mutations in genes or also noncoding nucleic acid regions (which for example are important for the regulation of expression) and then prepare gene libraries. The necessary methods of molecular biology are known by a person skilled in the art and for example are described in Sambrook and Russell, Molecular Cloning, 3rd edition, Cold Spring Harbor Laboratory Press 2001.

Methods for altering genes and therefore for altering the proteins that they encode have long been familiar to a person skilled in the art, for example site-directed mutagenesis, in which single or several nucleotides of a gene are deliberately exchanged (Trower M K (Ed.); In vitro mutagenesis protocols, Humana Press, New Jersey), saturation mutagenesis, in which a codon for any amino acid can be exchanged or added at any point of a gene (Kegler-Ebo D M, Docktor C M, DiMaio D (1994)

Nucleic Acids Res 22:1593; Barettino D, Feigenbutz M, Valcárel R, Stunnenberg H G (1994) Nucleic Acids Res 22:541; Barik S (1995) Mol Biotechnol 3:1), the error-prone polymerase chain reaction (error-prone PCR), in which nucleotide sequences are mutated by error-prone DNA polymerases (Eckert K A, Kunkel T A (1990) Nucleic Acids Res 18:3739);

the SeSaM method (sequence saturation method), in which preferred exchanges are prevented by the polymerase. Schenk et al., Biospektrum, Vol. 3, 2006, 277-279 the passaging of genes in mutator strains, in which, for example owing to defective DNA repair mechanisms, there is an increased mutation rate of nucleotide sequences (Greener A, Callahan M. Jerpseth B (1996) An efficient random mutagenesis technique using an E. coli mutator strain. In: Trower M K (Ed.) in vitro mutagenesis protocols. Humana Press, New Jersey), or DNA shuffling, in which a pool of closely related genes is formed and digested and the fragments are used as templates for a polymerase chain reaction, in which, by repeated strand separation and bringing together again, finally mosaic genes of full length are produced (Stemmer W P C (1994) Nature 370:389; Stemmer W P C (1994) Proc Natl Acad Sci USA 91:10747).

Using so-called directed evolution (described for instance in Reetz M T and Jaeger K-E (1999), Topics Curr Chem 200:31; Zhao H. Moore J C, Volkov A A, Arnold F H (1999), Methods for optimizing industrial enzymes by directed evolution, in: Demain A L, Davies J E (Ed.) Manual of industrial microbiology and biotechnology. American Society for Microbiology), a person skilled in the art can produce functional mutants in a directed manner and on a large scale. For this, in a first step, gene libraries of the respective proteins are first produced, for example using the methods given above. The gene libraries are expressed in a suitable way, for example by bacteria or by phage display systems.

The relevant genes of host organisms that express functional mutants with properties that largely correspond to the desired properties can be submitted to another round of mutation. The steps of mutation and selection or screening can be repeated iteratively until the present functional mutants have the desired properties to a sufficient extent. Using this iterative procedure, a limited number of mutations, for example 1, 2, 3, 4 or 5 mutations, can be effected in stages and can be assessed and selected for their influence on the enzyme property in question. The selected mutant can then be submitted to a further mutation step in the same way. In this way the number of individual mutants to be investigated can be reduced significantly.

The results according to the invention also provide important information relating to structure and sequence of the relevant enzymes, which is required for deliberately generating further enzymes with desired modified properties. In particular so-called "hot spots" can be defined, i.e. sequence segments that are potentially suitable for modifying an enzyme property by introducing targeted mutations.

Information can also be deduced regarding amino acid sequence positions, in the region of which mutations can be carried out that should probably have little effect on enzyme activity, and can be designated as potential "silent mutations".

3.3 Constructs

The invention further relates to, in particular recombinant, expression constructs, containing, under the genetic control of regulatory nucleic acid sequences, a nucleic acid sequence coding for a polypeptide according to the invention; and, in particular recombinant, vectors, comprising at least one of these expression constructs.

An "expression unit" means, according to the invention, a nucleic acid with expression activity, which comprises a promoter, as defined herein, and after functional linkage with a nucleic acid to be expressed or a gene, regulates the expression, i.e. the transcription and the translation of said nucleic acid or said gene. Therefore in this connection it is also called a "regulatory nucleic acid sequence". In addition to the promoter, other regulatory elements, for example enhancers, can also be present.

An "expression cassette" or "expression construct" means, according to the invention, an expression unit that is functionally linked to the nucleic acid to be expressed or the gene to be expressed. In contrast to an expression unit, an expression cassette therefore comprises not only nucleic acid sequences that regulate transcription and translation, but also the nucleic acid sequences that are to be expressed as protein as a result of the transcription and translation.

The terms "expression" or "overexpression" describe, in the context of the invention, the production or increase in intracellular activity of one or more enzymes in a microorganism, which are encoded by the corresponding DNA. For this, it is possible for example to introduce a gene into an organism, replace an existing gene with another gene, increase the copy number of the gene or genes, use a strong promoter or use a gene that codes for a corresponding enzyme with a high activity; optionally, these measures can be combined.

Preferably said constructs according to the invention comprise a promoter 5'-upstream of the respective coding sequence and a terminator sequence 3'-downstream and optionally other usual regulatory elements, in each case operatively linked with the coding sequence.

A "promoter", of a "nucleic acid with promoter activity" or of a "promoter sequence" means, according to the invention, a nucleic acid which, functionally linked to a nucleic acid to be transcribed, regulates the transcription of said nucleic acid.

A "functional" or "operative" linkage means, in this connection, for example the sequential arrangement of one of the nucleic acids with promoter activity and of a nucleic acid sequence to be transcribed and optionally further regulatory elements, for example nucleic acid sequences that ensure the transcription of nucleic acids, and for example a terminator, in such a way that each of the regulatory elements can perform its function during transcription of the nucleic acid sequence. This does not necessarily require a direct linkage in the chemical sense. Genetic control sequences, for example enhancer sequences, can even exert their function on the target sequence from more remote positions or even from other DNA molecules. Arrangements are preferred in which the nucleic acid sequence to be transcribed is positioned behind (i.e. at the 3'-end of) the promoter sequence, so that the two sequences are joined together covalently. The distance between the promoter sequence and the nucleic acid sequence to be expressed transgenically can be smaller than 200 base pairs, or smaller than 100 base pairs or smaller than 50 base pairs.

In addition to promoters and terminator, the following may be mentioned as examples of other regulatory elements: targeting sequences, enhancers, polyadenylation signals, selectable markers, amplification signals, replication origins and the like. Suitable regulatory sequences are described for example in Goeddel, Gene Expression Technology: Methods in Enzymology 185, Academic Press, San Diego, Calif. (1990).

Nucleic acid constructs according to the invention comprise in particular a sequence coding for a cyclase mutant, e.g. derived from SEQ ID NO: 1 or coding for a mutant of SEQ ID NO: 2 to 326 or derivatives and homologs thereof, and the nucleic acid sequences derivable therefrom, which have been linked operatively or functionally with one or more regulatory signals advantageously for controlling, e.g. increasing, gene expression.

In addition to these regulatory sequences, the natural regulation of these sequences can still be present before the actual structural genes and optionally can have been genetically altered, so that the natural regulation has been switched off and expression of the genes has been increased. The nucleic acid construct can, however, also be of simpler construction, i.e. no additional regulatory signals have been inserted before the coding sequence and the natural promoter, with its regulation, has not been removed. Instead, the natural regulatory sequence is mutated so that regulation no longer takes place and gene expression is increased.

A preferred nucleic acid construct advantageously also contains one or more of the "enhancer" sequences already mentioned, functionally linked to the promoter, which make increased expression of the nucleic acid sequence possible. Additional advantageous sequences can also be inserted at the 3'-end of the DNA sequences, such as further regulatory elements or terminators. One or more copies of the nucleic acids according to the invention can be contained in the construct. The construct can also contain other markers, such as antibiotic resistances or auxotrophy complementing genes, optionally for selection on the construct.

Examples of suitable regulatory sequences are contained in promoters such as cos-, tac-, trp-, tet-, trp-tet-, lpp-, lac-, lpp-lac-, lacI$^q$, T7-, T5-, T3-, gal-, trc-, ara-, rhaP (rhaP$_{BAD}$) SP6-, lambda-P$_R$- or in the lambda-P$_L$-promoter, which advantageously find application in gram-negative bacteria. Further advantageous regulatory sequences are contained for example in the gram-positive promoters amy and SPO2, in the yeast or fungal promoters ADC1, MFalpha, AC, P-60, CYC1, GAPDH, TEF, rp28, ADH, Artificial promoters can also be used for regulation.

For expression in a host organism, the nucleic acid construct is advantageously inserted into a vector, for example a plasmid or a phage, which makes optimal expression of the genes in the host possible. Apart from plasmids and phage, vectors are also to be understood as all other vectors known by a person skilled in the art, e.g. viruses, such as SV40. CMV, baculovirus and adenovirus, transposons. IS elements, phasmids, cosmids, and linear or circular DNA. These vectors can be replicated autonomously in the host organism or can be replicated chromosomally. These vectors represent a further embodiment of the invention.

Suitable plasmids are for example in *E. coli* pLG338, pACYC184, pBR322, pUC18, pKC30, pRep4, pHS1, pKK223-3, pDHE19.2, pHS2, pPLc236, pMBL24, pLG200, pUR290, pIN-III[113]-B1, λgt11 or pBdCl, in *Streptomyces* pIJ101, pIJ364, pIJ702 or pIJ361, in *Bacillus* pUB110, pC194 or pBD214, in *Corynebacterium* pSA77 or pAJ667, in fungi pALS1, pIL2 or pBB116, in yeasts 2alphaM, pAG-1, YEp6, YEp13 or pEMBLYe23 or in plants pLGV23, pGHlac$^+$, pBIN19, pAK2004 or pDH51. The stated plasmids represent a small selection of the possible plasmids. Further plasmids are well known by a person skilled in the art and can for example be found in the book Cloning Vectors (Eds. Pouwels P. H. et al. Elsevier, Amsterdam-New York-Oxford, 1985, ISBN 0 444 904018).

In another embodiment of the vector, the vector containing the nucleic acid construct according to the invention or the nucleic acid according to the invention can also advantageously be introduced in the form of a linear DNA into the microorganisms and integrated via heterologous or homologous recombination into the genome of the host organism. This linear DNA can consist of a linearized vector such as a plasmid or only of the nucleic acid construct or the nucleic acid according to the invention.

For optimal expression of heterologous genes in organisms, it is advantageous to alter the nucleic acid sequences corresponding to the specific "codon usage" used in the organism. The "codon usage" can easily be determined on the basis of computer evaluations of other known genes of the organism in question.

An expression cassette according to the invention is produced by fusion of a suitable promoter with a suitable coding nucleotide sequence and a terminator signal or polyadenylation signal. Common recombination and cloning techniques are used, as described for example in T. Maniatis, E. F. Fritsch and J. Sambrook, Molecular Cloning: A Laboratory Manual, Cold Spring Harbor Laboratory, Cold Spring Harbor, N.Y. (1989) and in T. J. Silhavy, M. L. Berman and L. W. Enquist, Experiments with Gene Fusions, Cold Spring Harbor Laboratory, Cold Spring Harbor, N.Y. (1984) and in Ausubel, P. M. et al., Current Protocols in Molecular Biology, Greene Publishing Assoc. and Wiley Interscience (1987).

For expression in a suitable host organism, advantageously the recombinant nucleic acid construct or gene construct is inserted into a host-specific vector, which makes optimal expression of the genes in the host possible. Vectors are well known by a person skilled in the art and are given for example in "Cloning vectors" (Pouwels P. H. et al., Ed., Elsevier, Amsterdam-New York-Oxford, 1985).

4. Microorganisms

Depending on the context, the term "microorganism" can mean the wild-type microorganism or a genetically altered, recombinant microorganism or both.

Using the vectors according to the invention, recombinant microorganisms can be produced, which are for example transformed with at least one vector according to the invention and can be used for producing the polypeptides according to the invention. Advantageously, the recombinant constructs according to the invention, described above, are introduced into a suitable host system and expressed. Preferably common cloning and transfection methods, known by a person skilled in the art, are used, for example coprecipitation, protoplast fusion, electroporation, retroviral transfection and the like, for expressing the stated nucleic acids in the respective expression system. Suitable systems are described for example in Current Protocols in Molecular Biology, F. Ausubel et al., Ed., Wiley Interscience, New York 1997, or Sambrook et al. Molecular Cloning: A Laboratory Manual. 2nd edition, Cold Spring Harbor Laboratory, Cold Spring Harbor Laboratory Press, Cold Spring Harbor, N.Y., 1989.

In principle, all prokaryotic or eukaryotic organisms may be considered as recombinant host organisms for the nucleic acid according to the invention or the nucleic acid construct. Advantageously, microorganisms such as bacteria, fungi or yeasts are used as host organisms. Advantageously, gram-positive or gram-negative bacteria are used, preferably bacteria of the families Enterobacteriaceae, Pseudomonadaceae, Rhizobiaceae, Streptomycetaceae or Nocardiaceae, especially preferably bacteria of the genera *Escherichia, Pseudomonas, Streptomyces, Nocardia, Burkholderia, Salmonella, Agrobacterium, Clostridium* or *Rhodococcus*. The genus and species *Escherichia coli* is quite especially preferred. Furthermore, other advantageous bacteria are to be found in the group of alpha-Proteobacteria, beta-Proteobacteria or gamma-Proteobacteria.

The host organism or the host organisms according to the invention preferably contain at least one of the nucleic acid sequences, nucleic acid constructs or vectors described in the present invention, which code for an enzyme with phenylethanol dehydrogenase activity according to the above definition.

Depending on the host organism, the organisms used in the method according to the invention are grown or cultured in a manner known by a person skilled in the art. Microorganisms are as a rule grown in a liquid medium, which contains a carbon source generally in the form of sugars, a nitrogen source generally in the form of organic nitrogen sources such as yeast extract or salts such as ammonium sulfate, trace elements such as iron, manganese and magnesium salts and optionally vitamins, at temperatures between 0° C. and 100° C., preferably between 10° C. to 60° C. with oxygen aeration. The pH of the liquid nutrient can be kept at a fixed value, i.e. regulated or not during culture, Culture can be batchwise, semi-batchwise or continuous. Nutrients can be present at the beginning of fermentation or can be supplied later, semicontinuously or continuously.

5. Recombinant Production of Enzymes According to the Invention

The invention further relates to methods for recombinant production of polypeptides according to the invention or functional, biologically active fragments thereof, wherein a polypeptide-producing microorganism is cultured, optionally the expression of the polypeptides is induced and these are isolated from the culture. The polypeptides can also be produced in this way on an industrial scale, if desired.

The microorganisms produced according to the invention can be cultured continuously or discontinuously in the batch method or in the fed-batch method or repeated fed-batch method. A summary of known cultivation methods can be found in the textbook by Chmiel (Bioprozesstechnik 1, Einführung in die Bioverfahrenstechnik [Bioprocess technology 1. Introduction to bioprocess technology] (Gustav Fischer Verlag, Stuttgart, 1991)) or in the textbook by Storhas (Bioreaktoren und periphere Einrichtungen [Bioreactors and peripheral equipment] (Vieweg Verlag, Braunschweig/Wiesbaden, 1994)).

The culture medium to be used must suitably meet the requirements of the respective strains. Descriptions of culture media for various microorganisms are given in the manual "Manual of Methods for General Bacteriology" of the American Society for Bacteriology (Washington D.C., USA, 1981).

These media usable according to the invention usually comprise one or more carbon sources, nitrogen sources, inorganic salts, vitamins and/or trace elements.

Preferred carbon sources are sugars, such as mono-, di- or polysaccharides. Very good carbon sources are for example glucose, fructose, mannose, galactose, ribose, sorbose, ribulose, lactose, maltose, sucrose, raffinose, starch or cellulose. Sugars can also be added to the media via complex compounds, such as molasses, or other by-products of sugar refining. It can also be advantageous to add mixtures of different carbon sources. Other possible carbon sources are oils and fats, for example soybean oil, sunflower oil, peanut oil and coconut oil, fatty acids, for example palmitic acid, stearic acid or linoleic acid, alcohols, for example glycerol, methanol or ethanol and organic acids, for example acetic acid or lactic acid.

Nitrogen sources are usually organic or inorganic nitrogen compounds or materials that contain these compounds. Examples of nitrogen sources comprise ammonia gas or ammonium salts, such as ammonium sulfate, ammonium chloride, ammonium phosphate, ammonium carbonate or ammonium nitrate, nitrates, urea, amino acids or complex nitrogen sources, such as corn-steep liquor, soya flour, soya protein, yeast extract, meat extract and others. The nitrogen sources can be used alone or as a mixture.

Inorganic salt compounds that can be present in the media comprise the chloride, phosphorus or sulfate salts of calcium, magnesium, sodium, cobalt, molybdenum, potassium, manganese, zinc, copper and iron.

Inorganic sulfur-containing compounds, for example sulfates, sulfites, dithionites, tetrathionates, thiosulfates, sulfides, as well as organic sulfur compounds, such as mercaptans and thiols, can be used as the sulfur source.

Phosphoric acid, potassium dihydrogen phosphate or dipotassium hydrogen phosphate or the corresponding sodium-containing salts can be used as the phosphorus source.

Chelating agents can be added to the medium, in order to keep the metal ions in solution. Especially suitable chelating agents comprise dihydroxyphenols, such as catechol or protocatechuate, or organic acids, such as citric acid.

The fermentation media used according to the invention usually also contain other growth factors, such as vitamins or growth promoters, which include for example biotin, riboflavin, thiamine, folic acid, nicotinic acid, pantothenate and pyridoxine. Growth factors and salts often originate from the components of complex media, such as yeast extract, molasses, corn-steep liquor and the like. Moreover, suitable precursors can be added to the culture medium. The exact composition of the compounds in the medium is strongly dependent on the respective experiment and is decided for each specific case individually. Information on media optimization can be found in the textbook "Applied Microbiol. Physiology, A Practical Approach" (Ed, P. M. Rhodes, P. F. Stanbury, IRL Press (1997) p. 53-73. ISBN 0 19 963577 3), Growth media can also be obtained from commercial suppliers, such as Standard 1 (Merck) or BHI (brain heart infusion, DIFCO) and the like.

All components of the medium are sterilized, either by heat (20 min at 1.5 bar and 121° C.) or by sterile filtration. The components can either be sterilized together, or separately if necessary. All components of the medium can be present at the start of culture or can be added either continuously or batchwise.

The culture temperature is normally between 15° C. and 45° C., preferably 25° C. to 40° C. and can be varied or kept constant during the experiment. The pH of the medium should be in the range from 5 to 8.5, preferably around 7.0. The pH for growing can be controlled during growing by adding basic compounds such as sodium hydroxide, potassium hydroxide, ammonia or ammonia water or acid compounds such as phosphoric acid or sulfuric acid. Antifoaming agents, for example fatty acid polyglycol esters, can be used for controlling foaming. To maintain the stability of plasmids, suitable selective substances, for example antibiotics, can be added to the medium. To maintain aerobic conditions, oxygen or oxygen-containing gas mixtures, for example ambient air, are fed into the culture. The temperature of the culture is normally in the range from 20° C. to 45° C. The culture is continued until a maximum of the desired product has formed. This target is normally reached within 10 hours to 160 hours.

The fermentation broth is then processed further. Depending on requirements, the biomass can be removed from the fermentation broth completely or partially by separation techniques, for example centrifugation, filtration, decanting or a combination of these methods or can be left in it completely.

If the polypeptides are not secreted in the culture medium, the cells can also be lysed and the product can be obtained from the lysate by known methods for isolation of proteins. The cells can optionally be disrupted with high-frequency ultrasound, high pressure, for example in a French press, by osmolysis, by the action of detergents, lytic enzymes or organic solvents, by means of homogenizers or by a combination of several of the aforementioned methods.

The polypeptides can be purified by known chromatographic techniques, such as molecular sieve chromatography (gel filtration), such as Q-sepharose chromatography, on exchange chromatography and hydrophobic chromatography, and with other usual techniques such as ultrafiltration, crystallization, salting-out, dialysis and native gel electrophoresis. Suitable methods are described for example in Cooper, T. G., Biochemische Arbeitsmethoden [Biochemical processes], Verlag Walter de Gruyter, Berlin, New York or in Scopes, R., Protein Purification, Springer Verlag, New York, Heidelberg, Berlin.

For isolating the recombinant protein, it can be advantageous to use vector systems or oligonucleotides, which lengthen the cDNA by defined nucleotide sequences and therefore code for altered polypeptides or fusion proteins, which for example serve for easier purification. Suitable modifications of this type are for example so-called "tags" functioning as anchors, for example the modification known as hexa-histidine anchor or epitopes that can be recognized as antigens of antibodies (described for example in Harlow, E. and Lane. D., 1988, Antibodies: A Laboratory Manual. Cold Spring Harbor (N.Y.) Press). These anchors can serve for attaching the proteins to a solid carrier, for example a polymer matrix, which can for example be used as packing in a chromatography column, or can be used on a microtiter plate or on some other carrier.

At the same time these anchors can also be used for recognition of the proteins. For recognition of the proteins, it is moreover also possible to use usual markers, such as fluorescent dyes, enzyme markers, which form a detectable reaction product after reaction with a substrate, or radioactive markers, alone or in combination with the anchors for derivatization of the proteins.

For the expression of mutants according to the invention, reference may be made to the description of expression of the wild-type enzyme EbN1 and the expression systems usable for this in WO2005/108590 and WO2006/094945, to which reference is hereby expressly made.

6. Enzyme Immobilization

The enzymes according to the invention can be used free or immobilized in the method described herein. An immobilized enzyme is an enzyme that is fixed to an inert carrier. Suitable carrier materials and the enzymes immobilized thereon are known from EP-A-1149849. EP-A-1 069 183 and DE-OS 100193773 and from the references cited therein. Reference is made in this respect to the disclosure of these documents in their entirety. Suitable carrier materials include for example clays, clay minerals, such as kaolinite, diatomaceous earth, perlite, silica, aluminum oxide, sodium carbonate, calcium carbonate, cellulose powder, anion exchanger materials, synthetic polymers, such as polystyrene, acrylic resins, phenol formaldehyde resins, polyurethanes and polyolefins, such as polyethylene and polypropylene. For making the supported enzymes, the carrier materials are usually employed in a finely-divided, particulate form, porous forms being preferred. The particle size of the carrier material is usually not more than 5 mm, in particular not more than 2 mm (particle-size distribution curve). Similarly, when using dehydrogenase as whole-cell catalyst, a free or immobilized form can be selected. Carrier materials are e.g. Ca-alginate, and carrageenan. Enzymes as well as cells can also be crosslinked directly with glutaraldehyde (cross-linking to CLEAs). Corresponding and other immobilization techniques are described for example in J. Lalonde and A. Margolin "Immobilization of Enzymes" in K. Drauz and H. Waldmann, Enzyme Catalysis in Organic Synthesis 2002, Vol. III, 991-1032, Weinheim. Further information on biotransformations and bioreactors for carrying out methods according to the invention are also given for example in Rehm et al. (Ed.) Biotechnology, 2nd Edn, Vol 3, Chapter 17, VCH, Weinheim.

7. Enzymatic Cyclization of Terpenes 7.1 General Description

In particular, the method of cyclization according to the invention is carried out in the presence of an enzyme, wherein the enzyme is encoded by a nucleic acid sequence according to SEQ ID NO: 1 or a functional equivalent thereof, wherein the nucleic acid sequence is a constituent of a gene construct or vector. Said gene constructs or vectors are described in detail in international application PCT/EP2010/057696 on pages 16 to 20, to which reference is expressly made here. Said functional equivalents, in particular those with citronellal-isopulegol cyclase activity, comprise in particular an F486 or F486-analog mutation, as defined herein.

The host cell, which contains a gene construct or a vector, in which the nucleic acid sequence is contained that codes for the enzyme with the desired activity, is also designated as transgenic organism. The production of said transgenic organisms is known in principle and is discussed for example in international application PCT/EP2010/057696 on page 20, to which reference is expressly made here.

Cells from the group comprising bacteria, cyanobacteria, fungi and yeasts are preferably selected as transgenic organisms. The cell is preferably selected from fungi of the genus *Pichia* or bacteria of the genera *Escherichia, Corynebacterium, Ralstonia, Clostridium, Pseudomonas, Bacillus, Zymomonas, Rhodobacter, Streptomyces, Burkholderia, Lactobacillus* or *Lactococcus*. Especially preferably, the cell is selected from bacteria of the species *Escherichia coli, Pseudomonas putida, Burkholderia glumae, Streptomyces lividans, Streptomyces coelicolor* or *Zymomonas mobilis*.

A method according to the invention is preferred, characterized in that the enzyme with the activity of a citronellal-isopulegol cyclase is encoded by a gene that was isolated from a microorganism, selected from *Zymomonas mobilis, Methylococcus capsulatus, Rhodopseudomonas palustris, Bradyrhizobium japonicum, Frankia* spec, *Streptomyces coelicolor* and *Acetobacter pasteurianus*. The relevant genes isolated from *Zymomonas mobilis, Streptomyces coelicolor, Bradyrhizobium japonicum* and *Acetobacter pasteurianus* should be mentioned in particular.

A method according to the invention is further preferred, characterized in that the enzyme with cyclase activity was generated by a microorganism that overproduces the enzyme and that was selected from the group of microorganisms comprising the genera *Escherichia, Corynebacterium, Ralstonia, Clostridium, Pseudomonas, Bacillus, Zymomonas, Rhodobacter, Streptomyces, Burkholderia, Lactobacillus* and *Lactococcus*.

In particular, a method according to the invention should be mentioned that is characterized in that the enzyme with cyclase activity was produced by transgenic microorganisms of the species *Escherichia coli, Pseudomonas putida, Burkholderia glumae, Corynebacterium glutamicum, Saccharomyces cerevisiae, Pichia pastoris, Streptomyces lividans, Streptomyces coelicolor, Bacillus subtilis* or *Zymomonas mobilis*, which overproduce the enzyme with cyclase activity.

Further embodiments for carrying out the biocatalytic cyclization method according to the invention, such as, for example, the method for production of isopulegol:

The method according to the invention is characterized in that the enzyme is in at least one of the following forms:
a) free, optionally purified or partially purified polypeptide;
b) immobilized polypeptide;
c) polypeptide isolated from cells according to a) or b);
d) whole cell, optionally dormant or growing cells, comprising at least one such polypeptide;
e) lysate or homogenizate of the cell according to d).

Another embodiment of the method according to the invention is characterized in that the cells are microorganisms, preferably transgenic microorganisms expressing at least one heterologous nucleic acid molecule coding for a polypeptide with the cyclase activity.

A preferred embodiment of the method according to the invention comprises at least the following steps a), b) and d):
a) isolating or recombinantly producing a microorganism producing an enzyme with cyclase activity from a natural source or,
b) multiplying this microorganism,
c) optionally isolating the enzyme with cyclase activity from the microorganism or preparing a protein fraction comprising said enzyme, and
d) transferring the microorganism according to stage b) or the enzyme according to stage c) to a medium that contains substrate, e.g. citronellal of general formula (I).

In the method according to the invention, substrate, such as, for example, citronellal is contacted with the enzyme, that has the activity of a citronellal-isopulegol cyclase, in a medium and/or is incubated so that conversion of the substrate, such as, for example, of citronellal, to isopulegol, takes place in the presence of the enzyme. Preferably the medium is an aqueous reaction medium.

The pH of the aqueous reaction medium in which the method according to the invention is preferably carried out is advantageously maintained between pH 4 and 12, preferably between pH 4.5 and 9, especially preferably between pH 5 and 8.

The aqueous reaction media are preferably buffered solutions, which as a rule have a pH of preferably from 5 to 8. The buffer used can be a citrate, phosphate, TRIS (Tris(hydroxymethyl)-aminomethane) or MES buffer (2-(N-morpholino)ethanesulfonic acid). Moreover, the reaction medium can contain other additives, for example detergents (for example taurodeoxycholate).

The substrate, such as, for example, citronellal, is used preferably in a concentration of 2-200 mM, especially preferably 5-25 mM in the enzymatic reaction and can be supplied continuously or discontinuously.

As a rule the enzymatic cyclization takes place at a reaction temperature below the deactivation temperature of the enzyme used and above −10° C. Preferably the method according to the invention is carried out at a temperature between 0° C. and 95° C., especially preferably at a temperature between 15° C. and 60° C., in particular between 20 and 40° C., e.g. at about 25 to 30° C.

A method according to the invention in which the reaction of citronellal isopulegol takes place at a temperature in the range from 20 to 40° C. and/or a pH in the range from 4 to 8 is especially preferred.

As well as these single-phase aqueous systems, in another variant of the invention, two-phase systems are also used. Then, as well as an aqueous phase, organic, non-water-miscible reaction media are used as the second phase. As a result, the reaction products accumulate in the organic phase. After the reaction, the product, such as, for example, isopulegol, in the organic phase can easily be separated from the aqueous phase that comprises the biocatalyst.

A method according to the invention is preferred wherein the production of isopulegol takes place in single-phase aqueous systems or in two-phase systems.

The reaction product isopulegol can be extracted with organic solvents and optionally can be distilled for purification.

Suitable organic solvents are for example aliphatic hydrocarbons, preferably with 5 to 8 carbon atoms, such as pentane, cyclopentane, hexane, cyclohexane, heptane, octane or cyclooctane, halogenated aliphatic hydrocarbons, preferably with one or two carbon atoms, such as dichloromethane, chloroform, carbon tetrachloride, dichloroethane or tetrachloroethane, aromatic hydrocarbons, such as benzene, toluene, the xylenes, chlorobenzene or dichlorobenzene, aliphatic acyclic and cyclic ethers or alcohols, preferably with 4 to 8 carbon atoms, such as ethanol, isopropanol, diethyl ether, methyl-tert-butyl ether, ethyl-tert-butyl ether, dipropyl ether, diisopropyl ether, dibutyl ether, tetrahydrofuran or esters such as ethyl acetate or n-butyl acetate or ketones such as methyl isobutyl ketone or dioxane or mixtures thereof. Especially preferably, the aforementioned heptane, methyl-tert-butyl ether, diisopropyl ether, tetrahydrofuran, and ethyl acetate are used.

The cyclases used according to the invention can be used in the method according to the invention as free or immobilized enzyme, as already described above.

For the method according to the invention it is possible to use dormant or growing, free or immobilized cells, which contain nucleic acids, nucleic acid constructs or vectors coding for the cyclase. Lysed cells, such as cell lysates or cell homogenates can also be used. Lysed cells are for example cells that have been permeabilized by a treatment for example with solvents, or cells that have been disrupted by an enzyme treatment, by a mechanical treatment (e.g. French press or ultrasound) or by some other method. The resultant raw extracts are advantageously suitable for the method according to the invention. Purified or partially purified enzymes can also be used for the method.

Where tree organisms or enzymes are used for the method according to the invention, they are usefully isolated, via a filtration or centrifugation, for example, prior to the extraction.

The method according to the invention can be operated batchwise, semibatchise or continuously.

7.2. Enzymatic Cyclization of Citronellal

The citronellal of formula (II) used in accordance with the invention, and converted by means of an enzyme having citronellal-isopulegol cyclase activity, is available commercially both as (+)-R-citronellal of the formula (R-II) and as (−)-S-citronellal of the formula (S-II), and as a racemate of the formula (II).

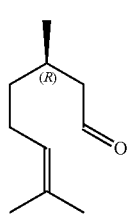

(R-II)

-continued (S-II)

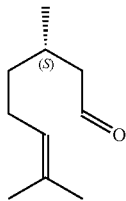

The isopulegol formed in accordance with the invention, of formula (I)

(I)

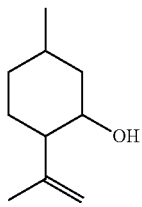

has a stereocenter in each of positions 1, 3 and 6, and so in principle there are 4 different diastereomers each with 2 enantiomers conceivable, in other words a total of 8 stereomers, if the starting point is the racemate of the citronellal of formula (I).

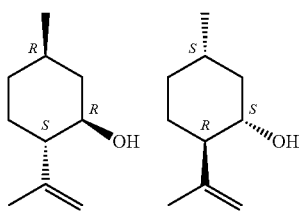

1R, 3R, 6S     1S, 3S, 6R

Isopulegol

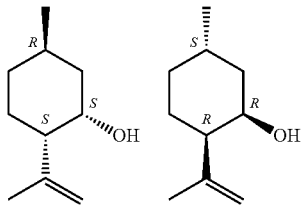

1S, 3R, 6S     1R, 3S, 6R

Neo-Isopulegol

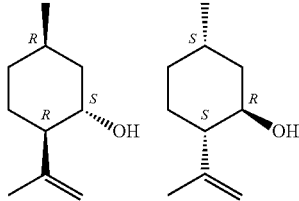

1S, 3R, 6R     1R, 3S, 6S

Iso-Isopulegol

-continued

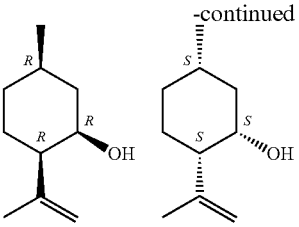

1R, 3R, 6R     1S, 3S, 6R

Epi-Isopulegol

Suitable enzymes having the activity of a citronellal-isopulegol cyclase are intramolecular transferases from the subclass of the isomerases; that is, proteins having the enzyme code EC 5.4 (enzyme code in accordance with Eur. J. Biochem. 1999, 264, 610-650). Preferably they are representatives having the enzyme code 5.4.99.17. Also suitable in particular as enzymes having the activity of citronellal-isopulegol cyclase are those cyclases which also bring about the cyclization of homofarnesol to ambroxan or of squalene to hopene, which are described exhaustively in international application PCT/EP2010/057696, hereby incorporated by reference; the enzymes and mutants described here are also suitable.

One particularly suitable embodiment of the method according to the invention is that wherein the enzyme used in the method according to the invention and having the activity of a citronellal-isopulegol cyclase possesses a polypeptide sequence which either
a) is SEQ ID NO: 2, or
b) in which up to 25% of the amino acid residues are altered relative to SEQ ID NO: 2 by deletion, insertion, substitution or a combination thereof, and which still has at least 50% of the enzymatic activity of SEQ ID NO: 2.

Suitable enzymes with citronellal-isopulegol cyclase activity and comprising an amino sequence according to SEQ ID NO: 2, and also "functional equivalents" or analogs of the specifically disclosed enzymes (E) having citronellal-isopulegol cyclase activity, are described, as already indicated above, exhaustively in the international application PCT/EP2010/057696, hereby incorporated by reference.

In one particularly preferred embodiment of the method, the enzyme having citronellal-isopulegol cyclase activity is selected from enzymes which comprise an amino acid sequence according to SEQ ID NO: 2 or a sequence derived therefrom in which up to 25%, preferably up to 20%, more preferably up to 15%, in particular up to 10, 9, 8, 7, 6, 5, 4, 3, 2, 1% of the amino acid residues have been altered by a deletion, a substitution, an insertion or a combination of deletion, substitution and insertion, the polypeptide sequences altered relative to SEQ ID NO: 2 still possessing at least 50%, preferably 65%, more preferably 80%, more particularly more than 90% of the enzymatic activity of SEQ ID NO: 2. In this context, enzymatic activity of SEQ ID NO: 2 refers to the capacity to effect biocatalytic cyclization of citronellal of general formula (II) to the corresponding isopulegol of formula (I).

The method according to the invention is carried out preferably in the presence of an enzyme, the enzyme being encoded by a nucleic acid sequence according to SEQ ID NO: 1 or a functional equivalent thereof.

Functional equivalents here describe in principle nucleic acid sequences which under standard conditions undergo hybridization with a nucleic acid sequence or parts of a nucleic acid sequence and are capable of bringing about the expression of a protein having the same properties as those of the enzyme having citronellal-isopulegol cyclase activity in a cell or in an organism.

A functional equivalent is additionally understood to refer to nucleic acid sequences which are homologous or identical to a defined percentage with a particular nucleic acid sequence ("original nucleic acid sequence") and have the same activity as the original nucleic acid sequences, and also, in particular, natural or artificial mutations of these nucleic acid sequences.

The nucleic acid sequences which can be used for encoding the enzymes having citronellal-isopulegol cyclase activity that can be used in the method according to the invention are likewise described exhaustively in international application PCT/EP2010/057696, hereby incorporated by reference.

With particular preference the method according to the invention is carried out in the presence of an enzyme, the enzyme being encoded by a nucleic acid sequence according to SEQ ID NO: 1 or a functional equivalent thereof, the nucleic acid sequence being part of a gene construct or vector. Such gene constructs or vectors are described exhaustively in international application PCT/EP2010/057696 on pages 16 to 20, hereby incorporated by reference.

With very particular preference the method according to the invention is carried out in the presence of an enzyme, where the enzyme is encoded by a nucleic acid sequence according to SEQ ID NO: 1 or a functional equivalent thereof, the nucleic acid sequence being part of a gene construct or vector which are present in a host cell.

The host cell which comprises a gene construct or a vector in which the nucleic acid sequence is present that encodes the enzyme having the citronellal-isopulegol cyclase activity is also referred to as a transgenic organism. The production of such transgenic organisms is known in principle and is discussed, for example, in international application PCT/EP2010/057696 on page 20, hereby incorporated by reference.

Transgenic organisms selected are preferably cells from the group consisting of bacteria, cyanobacteria, fungi and yeasts. The cell is preferably selected from fungi of the genus *Pichia* or bacteria of the genera *Escherichia, Corynebacterium, Ralstonia, Clostridium, Pseudomonas, Zymomonas, Rhodobacter, Streptomyces, Burkholderia, Lactobacillus* or *Lactococcus*. With particular preference the cell is selected from bacteria of the species *Escherichia coli, Pseudomonas putida, Burkholderia glumae, Streptomyces lividans, Streptomyces coelicolor* or *Zymomonas mobilis*.

A preferred method according to the invention is that wherein the enzyme having the activity of a citronellal-isopulegol cyclase is encoded by a gene which has been isolated from a microorganism selected from the group of microorganisms consisting of *Zymomonas mobilis, Methylococcus capsulatus, Rhodopseudomonas palustris, Bradyrhizobium japonicum, Frankia* spec. and *Streptomyces coelicolor*. With particular preference the gene in question has been isolated from *Zymomonas mobilis*.

Preferred furthermore is a method according to the invention wherein the enzyme having the activity of a citronellal-isopulegol cyclase has been produced by a microorganism which overproduces the enzyme having the activity of a citronellal-isopulegol cyclase and which has been selected from the group of microorganisms consisting of the genera *Escherichia, Corynebacterium, Ralstonia, Clostridium, Pseudomonas, Bacillus, Zymomonas, Rhodobacter, Streptomyces, Burkholderia, Lactobacillus* and *Lactococcus*.

A particularly preferred method according to the invention is that wherein the enzyme having the activity of a citronellal-isopulegol cyclase has been produced by transgenic microorganisms of the species *Escherichia coli, Pseudomonas putida, Burkholderia glumae, Corynebacterium glutamicum, Saccharomyces cerevisiae, Pichia pastoris, Streptomyces lividans, Streptomyces coelicolor, Bacillus subtilis* or *Zymomonas mobilis* which overproduce the enzyme having the activity of a citronellal-isopulegol cyclase.

The above-described further embodiments for carrying out the biocatalytic method according to the invention for cyclizing terpenes apply correspondingly in respect of the production of isopulegol.

A further subject of the present invention is also the use of an enzyme having the activity of a citronellal-isopulegol cyclase for the biocatalytic conversion of citronellal to isopulegol.

Preference is given to the use of an enzyme having the activity of a citronellal-isopulegol cyclase for the biocatalytic conversion of citronellal to isopulegol, wherein the enzyme possesses a polypeptide sequence which either
a) is SEQ ID NO: 2, or
b) in which up to 25% of the amino acid residues are altered relative to SEQ ID NO: 2 by deletion, insertion, substitution or a combination thereof, and which still has at least 50% of the enzymatic activity of SEQ ID NO: 2.

Also preferred is the use of an enzyme having the activity of a citronellal-isopulegol cyclase for the biocatalytic conversion of citronellal to isopulegol, wherein the enzyme is encoded by a nucleic acid sequence according to SEQ ID NO: 1 or a functional equivalent thereof.

A further subject of the present invention is also the use of a gene construct or vector comprising a nucleic acid sequence according to SEQ ID NO: 1 or a functional equivalent thereof which encode a polypeptide having the activity of a citronellal-isopulegol cyclase which serves the biocatalytic conversion of citronellal to isopulegol in a method of production of isopulegol by cyclization citronellal.

Likewise a further subject of the present invention is the use, as well, of a host cell which comprises a gene construct or a vector comprising a nucleic acid sequence according to SEQ ID NO: 1 or a functional equivalent thereof for producing an enzyme having the activity of a citronellal-isopulegol cyclase for the biocatalytic conversion of citronellal isopulegol.

The method described above opens up for the first time. The possibility of cyclizing citronellal to isopulegol by means of an enzyme.

8. Methods of Production of Menthol

The isopulegol prepared inventively can be converted into menthol by catalytic hydrogenation in a conventional way. Suitable for this purpose, as well as conventional hydrogenation processes, is, in particular, a catalytic method, as described in WO 2009/013192.

The method according to the invention is implemented in particular using catalysts comprising
45% to 55% by weight of oxygen-containing compounds of nickel, calculated as NiO,
25% to 35% by weight of oxygen-containing compounds of zirconium, calculated as $ZrO_2$,
5% to 20% by weight of oxygen-containing compounds of copper, calculated as CuO,
1% to 3% by weight of oxygen-containing compounds of molybdenum, calculated as $MoO_3$, and
0% to 5% by weight of further components,
the figures in % by weight adding up to 100% by weight and relating to the dry, unreduced catalyst.

One particularly preferred catalyst is composed of 49% to 53% by weight of NiO, 15% to 19% by weight of CuO, 28% to 32% by weight of ZrO$_2$ and 1% to 2% by weight of MoO$_3$ and also, optionally, 0% to 3% by weight of further components such as graphite, for example, the respectively selected weight fractions of the individual components being based on the dry, unreduced catalyst and adding up to 100% by weight. Catalysts of this kind are known and can be produced for example as described in EP 0 696 572 or in WO 2009/013192.

In general the catalysts are used preferably in the form of unsupported catalyst. The term "unsupported catalyst" refers to a catalyst which in contrast to a supported catalyst is composed only of catalytically active material. Unsupported catalysts can be used by introducing the catalytically active material, ground to a powder, into the reaction vessel, or by disposing the catalytically active material in the reactor after grinding, mixing with shaping aids, shaping and heat-treating in the form of shaped catalyst bodies—for example, as spheres, cylinders, tablets, rings, coils, strands and the like.

In the context of one preferred embodiment of the hydrogenation method according to the invention, the selected heterogeneous catalyst is employed in the form of a fixed-bed catalyst.

To implement the method according to the invention, the isopulegol starting material as described above is contacted with hydrogen and with the selected catalyst. The hydrogen here may be used in undiluted form, typically in a purity of about 99.9% by volume, or in diluted form, i.e. in the form of mixtures with inert gases such as nitrogen or argon, for example. It is preferred to use hydrogen in undiluted form. The reaction can be carried out successfully without adding solvent or in the presence of organic solvents which are inert under the reaction conditions, such as, for example, methanol, ethanol, isopropanol, hexane, heptane, cyclohexane and the like. It is preferred to carry out the reaction without adding solvent.

The hydrogenation of isopulegol in accordance with the invention can be carried out under a hydrogen pressure (absolute) in the range from 1 to 200 bar, such as from 2 or 3 to 200 bar, in particular from 4 or 5 to 150 bar, such as from 5 to 100 bar, or in the range from 5 to 50 bar. As a reaction temperature for implementing the hydrogenation according to the invention, a temperature is selected, advantageously, that is in the range from 20 to 150° C., such as from 40 to 130° C., or from 60 to 110° C. and more particularly from 70 to 100° C.

The practical approach to the implementation is generally to supply the isopulegol for conversion to the catalyst, which is typically located in a fixed bed reactor heated, in particular, from the outside, such as a tube reactor, autoclave or tube-bundle reactor, for example, at the desired reaction temperature and under the desired pressure. The velocity over the catalyst in this case is generally 0.1 to 1.0, such as 0.1 to 0.6 or 0.2 to 0.4, kg of isopulegol per kg of catalyst per hour. In this context it may be useful to heat the isopulegol that is to be used, even before it is supplied to the reaction vessel or to the reactor, this heating being preferably to reaction temperature.

The reactor can be operated either in liquid phase mode or in trickle mode—that is, the starting materials may be passed through the reactor either from bottom to top or from top to bottom. The hydrogenation method of the invention can be carried out either batchwise or continuously. In both cases, unreacted starting material can be circulated together with the hydrogen.

The hydrogenation according to the invention may also be carried out in stages in a cascade of two or more reactors, i.e. 2 to in general 4, such as 2 or 3, for example, reactors connected in series, preferably fixed bed reactors. In this case, in the first reactor, typically referred to as the main reactor, the main conversion of the reaction is achieved under the reaction conditions described above, and the crude product obtained is passed to a second reactor, typically referred to as secondary reactor, in which the as yet unreacted starting material is at least largely converted inventively into L-menthol. The reaction conditions here may be selected, independently of one another, preferably in the ranges stated above.

The method of the invention can be carried out batchwise, semibatchwise or continuously. It is preferred to carry out the method continuously, more particularly entirely continuously, in which case the starting materials are introduced continuously into the reactor and the resulting reaction mixture or reaction product is discharged continuously from the reactor. It has further proven advantageous, in view of the position of the melting point of the reaction product according to the invention, namely menthol, especially L-menthol, to provide for heating of the transport lines used.

The method of the invention allows menthol to be produced by catalytic hydrogenation of isopulegol, with typically only a minor degree of formation of unwanted diastereomers of menthol. Accordingly, when using isopulegol with a corresponding purity, the method of the invention yields menthol of the formula (III) in a chemical purity of 97% by weight or more, preferably of 98% to 100% by weight, more preferably of 98.5% to 99.9% by weight, very preferably at least 99% to 99.9% by weight. The term "chemical purity" here also encompasses the diastereomeric purity of the resulting menthol in relation to the diastereomers neoisomenthol of formula (IIIa), neomenthol of formula (IIIb) and isomenthol of formula (IIIc). Accordingly, in the context, the method according to the invention preferably yields menthol having a diastereomeric purity of 97% by weight or more, preferably of 98% to 100% by weight, more preferably of 98.5% to 99.9% by weight and very preferably of at least 99% to 999% by weight.

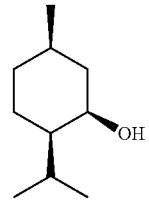

(IIIa)

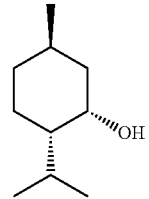

(IIIb)

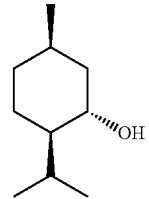

(IIIc)

Where isopulegol is used in optically active form—preferably, in accordance with the invention, mixtures comprising predominantly the L-isopulegol enantiomer—the method product according to the invention that is obtained is generally menthol in optically active form, preferably in the form of (−)- or L-menthol. The hydrogenation according to the invention proceeds generally largely without notable racemization of the material used. Accordingly, according to the enantiomeric excess of the optically active isopulegol used, optically active menthol, preferably L-menthol when using L-isopulegol, is obtained as the product, with an enantiomeric excess (ee) of 80% ee or more, preferably of 85% or 90% ee or more, more preferably of 95% to 100% ee, more preferably of 96% to 99.9% ee, very preferably of 97% to 99.8% ee, even more preferably of 98% to 99.7% ee, and with more particular preference of 98.5% to 99.6% ee.

The menthol obtained according to the invention is notable, furthermore, for a particularly low level of the unwanted by-products menthone of formula (IIId) and isomenthone of formula (IIIe) and neoisomenthol of formula (IIIa).

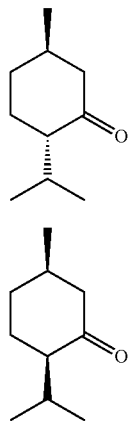

These by-products are obtained generally, in the context of the method according to the invention, only in a proportion, relative to the amount of menthol obtained, of up to 0.5% by weight, preferably 0.4% by weight, more preferably 0.3% by weight, more particularly 0.2% by weight, and very preferably 0.1% to 0% by weight.

9. Examples of Substrates which can be Used for Enzymatic or Biocatalytic Conversions According to the Invention The enzymes and microorganisms described herein are especially suitable for converting compounds of the general formula IV above. Non-limiting examples thereof are summarized in table A below, which gives the structural formula and the chemical name.

TABLE A

| Further substrates | |
|---|---|
| Formula (IV) | Name |
| ![structure] | Citral |
| ![structure] | Neral |
| ![structure] | Nerol |
| ![structure] | Nerylacetone |
| ![structure] | Geranial |
| ![structure] | Geraniol |
| ![structure] | Geranylic acid |

TABLE A-continued
Further substrates
Formula
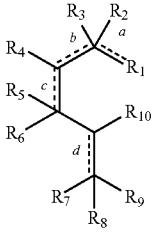
(IV)
| Name | Structure |
|---|---|
| cis-Geranylic acid | 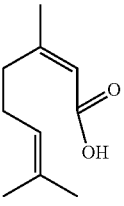 |
| Geranylacetone | 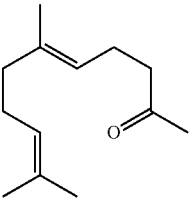 |
| Farnesol | 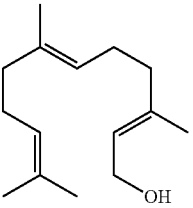 [SMILES: CC(C)=CCC/C(C)=C/CC/C(C)=C/CO] |
| Farnesylacetone | 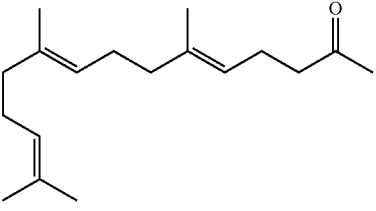 [SMILES: CC(=O)CC/C=C(\C)CC/C=C(\C)CCC=C(C)C] |
| Homofarnesylic acid | 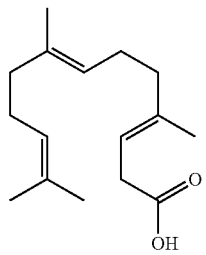 [SMILES: CC(C)=CCC/C(C)=C/CC/C(C)=C/CC(=O)O] |
| Homofarnesol | 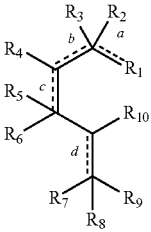 |
| Trimethyl-tridecatetraene | 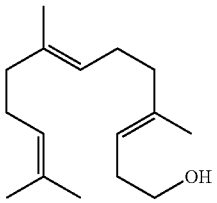 [SMILES: CC(C)=CCC/C(C)=C/CC/C(C)=C/CCO] |
| Melonal | 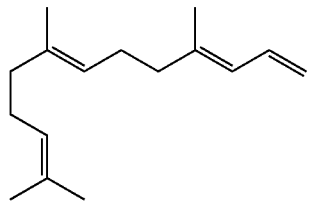 [SMILES: C=C/C=C(\C)CC/C=C(\C)CCC=C(C)C] |
| Nonadienal | 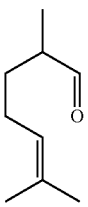 |
| Citronellol | 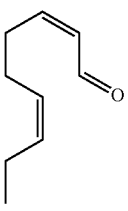 |
| β-Citronellene | 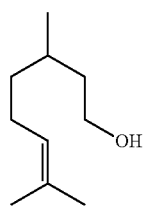 |

TABLE A-continued

Further substrates

Formula (IV)

| Name |
|---|
| Citronellic acid |
| Hydroxycitronellal |
| Heptanal |
| Linalool |
| Farnesene (β) |
| Myrcene |
| Myrcenol |
| Dihydromyrcenol |
| Lavandulol |
| Nerolidol |
| (E)-β-Ocimene (4 isomers present) |
| Tagetone |

TABLE A-continued

Further substrates

| Formula | Name |
|---|---|
| (IV) structure with $R_1$–$R_{10}$ substituents, positions a, b, c, d | |
| structure | Solanone |
| structure | 2,6,10-Trimethyl-9-undecanal |

The reaction products produced in the conversion of these substrates can be detected and quantified in a conventional way using standard analytical methods, such as chromatography, HPLC, gas chromatography, mass spectrometry, GC/MS n, MALDI-TOF, and combinations thereof.

If nonimmobilized organisms or enzymes are used for the method according to the invention, preferably these are separated prior to extraction, for example by filtration or centrifugation.

The method according to the invention can be operated batchwise, semi-batchwise or continuously.

Experimental Section

In the absence of special information in the examples below, the general information below is taken to apply.

A. General Information

All materials and microorganisms used are commercially available products.

Unless stated otherwise, the cloning and expression of recombinant proteins is carried out by standard methods, as described for example in Sambrook, J., Fritsch, E. F. and Maniatis. T., Molecular Cloning: A Laboratory Manual, 2nd edition, Cold Spring Harbor Laboratory, Cold Spring Harbor Laboratory Press, Cold Spring Harbor, N.Y., 1989.

a) Bacterial Strains, Plasmids and Growing Conditions

All experiments were carried out with *E. coli*. The SHC proteins were expressed in *E. coli* BL21 (DE3) pLySS or *E. coli* Rosetta pLysRAR62, comprising pET16b constructs with the respective shc gene, by growing in Luria-Bertani medium, supplemented with ampicillin (100 µg/ml), chloramphenicol (34 µg/ml); and 0.5 mM isopropylthio-β-D-galactoside at $OD_{600}$ of 0.4 and additional growth for 4 hours at 30° C.

b) Vector Constructs

The respective squalene-hopene cyclase gene (e.g. *Zymomonas mobilis* ZMO1548 [NC_006526.2, region: 1578816 . . . 1580993]) was PCR-amplified from chromosomal DNA, using corresponding primer pairs (e.g. ZMO1548-fwd (5'-gcgctgtttcatatgggtattgaca-3') (SEQ. ID. NO: 327) and ZMO1548-rev (5'-gcgcttaccctggatcctcgaaaat-3') (SEQ. ID. NO: 328)). The restriction enzyme digested (e.g. with NdeI/BamHI) PCR product was cloned into pET16b, (obtaining e.g.) pET1584. The constructs were verified by DNA sequencing and transformed into *E. coli* XL1-blue.

The shc-gene from other microorganisms (e.g. from *A. acidocaidarius*) was cloned similarly.

All plasmids were transformed individually into *E. coli* BL21 (DE3) pLysS or *E. coli* Rosetta pLys-RAR62.

c) Cyclization Assay with Various Substrates (Standard Conditions)

Recombinant *E. coli* cells were suspended in 20 mM Tris-HCl pH 8.0 (3 ml per g moist cells). The cyclization mixture contained 250 µl of cell suspension, 50 µl of 1 M citrate buffer (pH 4.5), 20 mM (final concentration) of substrate and water to 500 µl. In the cyclization of squalene, 1% (v/v) Triton-X100 was added. For the homofarnesol cyclization. *E. coli* cells (6 g moist cells) were suspended in solubilization buffer (50 mM phosphate, 10 mM $MgCl_2$ (pH 6.5; total volume: 25 ml). The cells were lysed at 1500 bar using a Manton-Gaulin homogenizer. Insoluble cellular debris was centrifuged off (15 min at 4° C. and 7150*g). The cyclization mixture contained 1 ml raw cell extract and 20 mM homofarnesol in 1.25 ml buffer (50 mM potassium phosphate, 45 mM $MgCl_2$ (pH 6.5). The reaction mixture was stirred at 30° C. with a magnetic stirrer. The reaction was stopped by extraction with heptane. The organic phase was analyzed by gas chromatography. Controls were carried out with *E. coli* cells bearing an empty vector and with heat-inactivated SHC-expressing cells. Formation of cyclization products was never observed with the controls (data not shown).

d) Gas Chromatography

Terpenoids were analyzed qualitatively and quantitatively by gas chromatography using an Agilent 7890A gas chromatograph, equipped with a DB-5 column (20 m×0.1 mm×0.1 µm) and an ionization detector. 3 µl of the solvent extract was applied on the column (split ratio 1:5, helium flow rate 0.25 or 0.5 ml/min, injector temperature 250° C.).

To separate linear and cyclic monoterpenoids, the initial furnace temperature (60° C.) was raised to 130° C. at 40° C./min, at 2° C./min to 150° C. and then at 40° C./min to 200° C. The retention times of the terpenoids were as follows: (R, S)-citronellal (755 min), isopulegol (770 min), neo-isopulegol (7.90 min), iso-isopulegol (8.10 min), neoiso-isopulegol (8.25 min), 1-decanol (9.91 min).

For the detection of triterpenes, the injector temperature was set at 300° C. The furnace temperature was initially 60° C., and was increased at 40"C/min to 220° C. and then at 6'C/min to 310° C. and held constant there for 10 min. Squalene and hopene eluted after 19.2 min and 26.9 min respectively.

Homofarnesol and ambroxan were analyzed on a 10 m Optima 1 column (Macherey & Nagel, Düren, Germany). The initial furnace temperature (100° C.) was increased at 5° C./min to 200° C. and held at this temperature for 5 min. Then it was increased at 30° C./min to 320° C. An analysis took 40 min. The retention times were as follows: homofarnesol (10.8 min), ambroxan (9.9 min). As an alternative, a Shimadzu GC-MS OP 2010 system with an FS Supreme 5 column (30 m×0.25 mm×0.25 µm) was used for coupled GC/MS analysis (split ratio 1:20; 3 min 120° C., increase to 135° C. at 2° C./min and further increase to 365° C. at 10° C./min, followed by cooling to 300° C. at 70° C./min). The GC-MS data were analyzed using LabSolutions GCsolutions Postrun software. It should be noted that the substrates citronellal racemate, (R)-citronellal and (S)-citronellal always contain small amounts of isopulegol and neo-isopulegol as impurities. The GC surface values for these linear terpenoids were established as 100%. The surface values for the isopulegol isomers in the product were corrected by the amount of isopulegol isomer that was already present in the substrate. The standard deviation was calculated on the basis of 24 individual tests using two separately grown *E. coli* cultures.

B. Examples

Example 1: Production of Mutants of the F486X Type of the Squalene-Hopene Cyclases by Rational Protein Design Using Quick-Change Mutagenesis The mutants of various squalene-hopene, cyclases were incorporated by means of "quick-change" mutagenesis into the corresponding gene. The procedure based on the manufacturer's information (Agilent Technologies, Waldbronn) was largely followed. First, a FOR was carried out:

PCR charge:
  1.8 µl DMSO
  2 µl dNTPs (each 2.5 mM)
  1.5 µl forward primer (10 pmol/µl)
  1.5 µl reverse primer (10 pmol/µl)
  1 µl templates (1 µg/µL; recombinant plasmid bearing SHC gene, for example pETZmSHC_1)
  0.2 µl Prime-Star Polymerase (Takara, 2.5 Units/µl)
  6 µl 5× buffer
  16 µl H$_2$O
PCR program:
  (1) 95° C. 3 minutes
  (2) 95° C. 45 seconds
  (3) 53° C. 1 minute
  (4) 68° C. 17 minutes
  5× repetition of steps (2), (3) and (4)

After the PCR, 10 µl of the charge was digested with the restriction enzyme DpnI for at least 1 hour at 37° C. Then transformation into *E. coli* XL1-blue cells was carried out. After DNA sequencing, transformation into the expression strain e.g. *E. coli* Rosetta pLysRAR62 took place. The gene can also be modified similarly in other expression plasmids.

The following primers were used for the quick-change PCR. The respective exchange is shown printed in bold in the primer names. The genes that are modified by the respective primers are indicated with italics in the primer names; there is the following correspondence:

| Primer name | Sequence | SEQ ID NO |
|---|---|---|
| ZmSHC_1F486Ilefor | GTTATTATCCTTATCGATGGCTCCCCAACCG | 329 |
| ZmSHC_1F486Ilerev | GGTTGGGGAGCCATCGATAAGGATAATAACAG | 330 |
| ZmSHC_1F486Metfor | GTTATTATCCTTATCCATGGCTCCCCAACCG | 331 |
| ZmSHC_1F486Metrev | GGTTGGGGAGCCATGGATAAGGATAATAACAG | 332 |
| ZmSHC_1F486Thrfor | GTTATTATCCTTATCGGTGGCTCCCCAACCG | 333 |
| ZmSHC_1F486Thrrev | GGTTGGGGAGCCACCGATAAGGATAATAACAG | 334 |
| ZmSHC_1F486Glnfor | GTTATTATCCTTATCCTGGGCTCCCCAACCG | 335 |
| ZmSHC_1F486Glnrev | GGTTGGGGAGCCCAGGATAAGGATAATAACAG | 336 |
| ZmSHC_1F486Asnfor | GTTATTATCCTTATCGTTGGCTCCCCAACCG | 337 |
| ZmSHC_1F486Asnrev | GGTTGGGGAGCCAACGATAAGGATAATAACAG | 338 |
| ZmSHC_1F486Lysfor | GTTATTATCCTTATCTTTGGCTCCCCAACCG | 339 |
| ZmSHC_1F486Lysrev | GGTTGGGGAGCCAAAGATAAGGATAATAACAG | 340 |
| ZmSHC_1F486Aspfor | GTTATTATCCTTATCATCGGCTCCCCAACCG | 341 |
| ZmSHC_1F486Asprev | GGTTGGGGAGCCGATGATAAGGATAATAACAG | 342 |
| ZmSHC_1F486Glufor | GTTATTATCCTTATCTTCGGCTCCCCAACCG | 343 |
| ZmSHC_1F486Glurev | GGTTGGGGAGCCGAAGATAAGGATAATAACAG | 344 |
| ZmSHC_1F486Trpfor | GTTATTATCCTTATCCCAGGCTCCCCAACCG | 345 |
| ZmSHC_1F486Trprev | GGTTGGGGAGCCTGGGATAAGGATAATAACAG | 346 |
| ZmSHC_1F486Argfor | GTTATTATCCTTATCACGGGCTCCCCAACCG | 347 |
| ZmSHC_1F486Argrev | GGTTGGGGAGCCCGTGATAAGGATAATAACAG | 348 |
| ZmSHC_1F486Cysfor | GTTATTATCCTTATCGCAGGCTCCCCAACCG | 349 |
| ZmSHC_1F486Cysrev | GGTTGGGGAGCCTGCGATAAGGATAATAACAG | 350 |
| ZmSHC_1F486Gfor | GTTATTATCCTTATCACCGGCTCCCCAACCG | 351 |
| ZmSHC_1F486Grev | GGTTGGGGAGCCGGTGATAAGGATAATAACAG | 352 |
| ZmSHC_1F486Sfor | GTTATTATCCTTATCGCTGGCTCCCCAACCG | 353 |
| ZmSHC_1F486Srev | GGTTGGGGAGCCAGCGATAAGGATAATAACAG | 354 |
| ZmSHC_1F486Pfor | GTTATTATCCTTATCCGGGGCTCCCCAACCG | 355 |
| ZmSHC_1F486Prev | GGTTGGGGAGCCCCGGATAAGGATAATAACAG | 356 |
| ZmSHC_1F486Hfor | GTTATTATCCTTATCATGGGCTCCCCAACCG | 357 |
| ZmSHC_1F486Hrev | GGTTGGGGAGCCCATGATAAGGATAATAACAG | 358 |

-continued

| Primer name | Sequence | SEQ ID NO |
|---|---|---|
| ZmSHC_1F486Lfor | GTTATTATCCTTATCCAGGGCTCCCCAACCG | 359 |
| ZmSHC_1F486Lrev | GGTTGGGGAGCCCTGGATAAGGATAATAACAG | 360 |
| ZmSHC_1F486Vfor | GTTATTATCCTTATCAACGGCTCCCCAACCG | 361 |
| ZmSHC_1F486Vrev | GGTTGGGGAGCCGTTGATAAGGATAATAACAG | 362 |
| ZmSHC_1F486Afor | GTTATTATCCTTATCCGCGGCTCCCCAACCG | 363 |
| ZmSHC_1F486Arev | GGTTGGGGAGCCGCGGATAAGGATAATAACAG | 364 |
| ZmSHC_1F486Yfor | GTTATTATCCTTATCATAGGCTCCCCAACCG | 365 |
| ZmSHC_1F486Yrev | GGTTGGGGAGCCTATGATAAGGATAATAACAG | 366 |
| ZmSHC_1Y702Cfor | GCCGATAAAAATCGCAACGCAGCATAAACG | 367 |
| ZmSHC_1Y702Crev | CGTTTATGCTGCGTTGCGATTTTTATCGGC | 368 |
| ZmSHC_1Y702Ffor | GCCGATAAAAATCTTTACGCAGCATAAACG | 369 |
| ZmSHC_1Y702Frev | CGTTTATGCTGCGTAAAGATTTTTATCGGC | 370 |
| ZmSHC_1Y702Afor | GCCGATAAAAATCCGCACGCAGCATAAACG | 371 |
| ZmSHC_1Y702Arev | CGTTTATGCTGCGTGCGGATTTTTATCGGC | 372 |
| ZmSHC_1Y702Sfor | GCCGATAAAAATCGCTACGCAGCATAAACG | 373 |
| ZmSHC_1Y702Srev | CGTTTATGCTGCGTAGCGATTTTTATCGGC | 374 |
| ZmSHC_1Y561Afor | GAACCGCACCGGTGCCATAGATCGCATTAACG | 375 |
| ZmSHC_1Y561Arev | GGTTTGGTCGTTGGGGCGTTAATGCGATCTATGG | 376 |
| ZmSHC_1Y705Afor | CCATAATCGGGAAGAATTGCCGCGCAAAATC | 377 |
| ZmSHC_1Y705Arev | CTGCGTTATGATTTTGCGCGGCAATTCTTC | 378 |
| ZmSHC_2F486Cfor | GGCGGTTGGGGCGCTTGCGATGCCAATAACAG | 379 |
| ZmSHC_2F486Crev | CTGTTATTGGCATCGCAAGCGCCCCAACCGCC | 380 |
| ApF486Crev | CATTATCTTTATCGCATGCACCCCAACCACC | 381 |
| ApF486Cfor | GGTGGTTGGGGTGCATGCGATAAAGATAATG | 382 |
| BjF486Cfor | CGGCTGGGGCGCGTGCGATAAAGATAAC | 383 |
| BjF486Crev | GTTATCTTTATCGCACGCGCCCCAGCCG | 384 |
| ScF486Cfor | CGGCGCCTGGGGCGCCTGCGACGTCGACAAC | 385 |
| ScF486Crev | GTTGTCGACGTCGCAGGCGCCCCAGGCGCCG | 386 |

ZmSHC_1 SEQ ID NO: 2;
ZmSHC_2 SEQ ID NO: 6;
Ap SEQ ID NO: 4;
Bj SEQ ID NO: 5 and
Sc SEQ ID NO: 3.

Example 2: Activity Tests with Mutants of Squalene-hopene Cyclase-1 (SHC-1) from *Zymomonas mobilis*

The influence of various single mutations, produced according to example 1, in the sequence position corresponding to F486, on the cyclase activity was determined for various substrates.

a) Citronellal

After the general detection of a slight cyclization activity of the squalene-hopene cyclase-1 from *Zymomonas mobilis* (SEQ ID NO:2) with respect to citronellal, the turnover rate was greatly improved by rational protein design. Exchange of the phenylalanine residue F486 for alanine led in preliminary tests (cf. FIG. 2) to a greatly increased production of isopulegol (2) starting from citronellal (1).

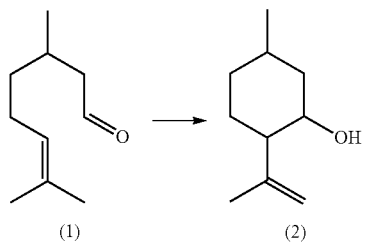

The increased activity of the SHC_1-F486A mutant was then investigated in more detail. In addition to a for better conversion of the citronellal substrate, it was also found that this prefers the R(+) isomer as substrate and compared with the WT it is also converted in a much shorter time (cf. FIG. 2). Whereas with the WT enzyme the reaction with R(+)-citronellal is not measurable until after quite long incubation, the F486A mutant shows high conversions, in particular at the start of the reaction. This effect is not observed with S(−)-citronellal as substrate. It is notable that the F486A mutant only forms isopulegol I and II, whatever the stereoconfiguration of the substrate. The WT, in contrast, is dependent on the stereoconfiguration of the substrate and forms, as well as isopulegol I, mainly isopulegol II from R(+)-citronellal and almost exclusively isopulegol III from S(−)-citronellal.

Figure 3:
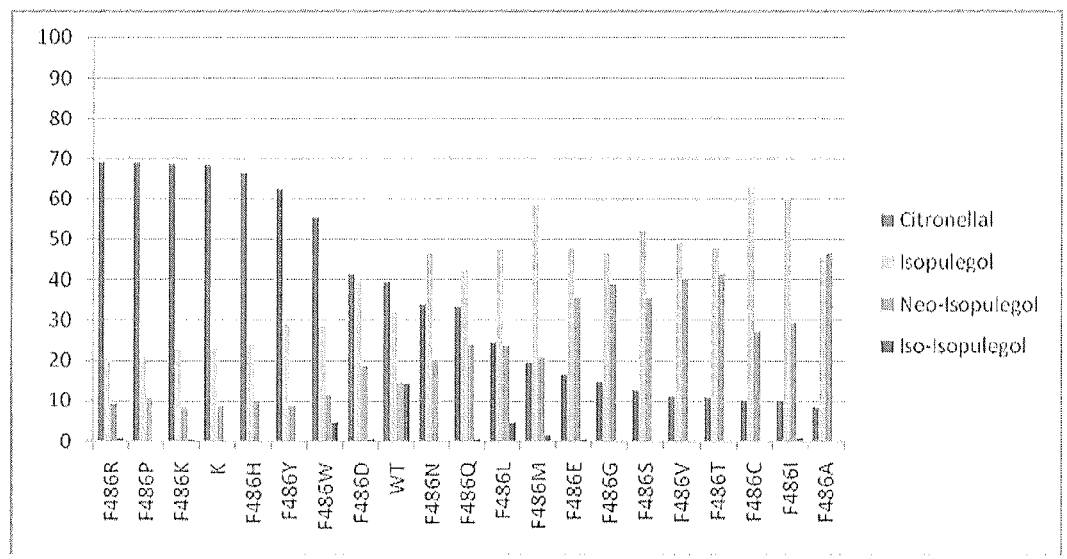
FIG. 3 shows the turnover of the various mutants of Zm-SHC-1 compared with the wild type (wt) and the control without enzyme (K) with 10 mM citronellal racemate as substrate. The percentage distribution of substrate and isopulegol product isomers after incubation overnight at 30° C. is shown in each case.

Based on these results, in further experiments the importance of the amino acid residues at position 486 was investigated more closely. For this, by means of mutagenesis, the phenylalanine residue was exchanged against each further amino acid and the activity of the various muteins was tested with citronellal as substrate (for sequences see FIGS. 1a and b). It was found that some amino acids at this position not only improve the conversion of citronellal by the enzyme, but additionally lead to higher product specificity in the reaction, so that fewer isomers of isopulegol are produced (see FIG. 3).

Exchange for arginine, proline and lysine leads to a loss in activity with respect to citronellal. The amounts of product determined also occur, in the same distribution, as contamination in the negative control ('K' see FIG. 3). The highest activity was observed after exchange for valine, threonine, cysteine, isoleucine and alanine. Overall, the altered product spectrum of some muteins is notable. Not all show the formation of three isopulegol peaks as the wild type as well as the quantitative distribution differs.

There are altogether $2^3$ isopulegol isomers:

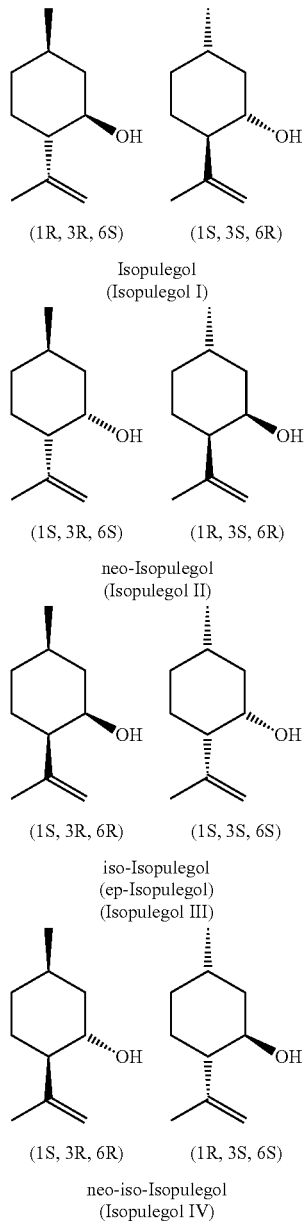

Isopulegol
(Isopulegol I)

neo-Isopulegol
(Isopulegol II)

iso-Isopulegol
(ep-Isopulegol)
(Isopulegol III)

neo-iso-Isopulegol
(Isopulegol IV)

Until now, the main product (isopulegol I) has been assigned to the enantiomeric pair (1R,3R,6S)-isopulegol or (1S,3S,6R)-isopulegol.

The highest yield of isopulegol with the least by-products (consisting of further isomers) accompanied by high enzyme activity is displayed by the Zm-SHC-1 F486C mutant.

b) Squalene

Figure 4:
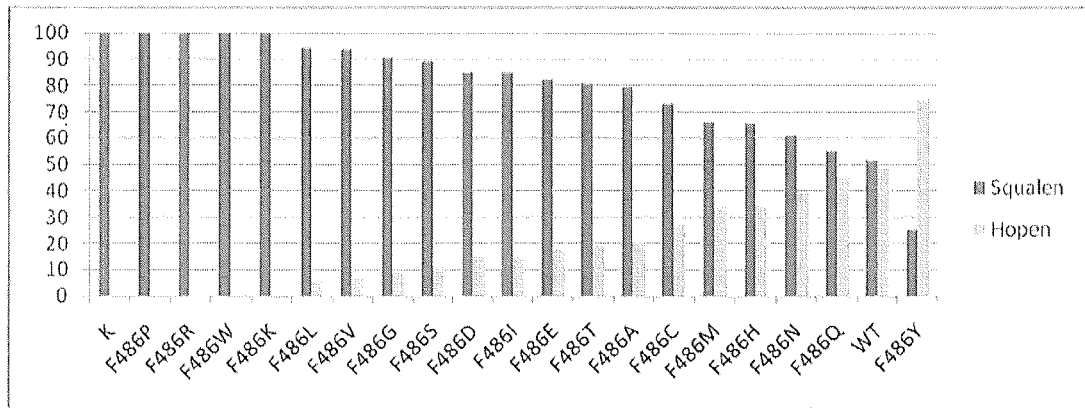
FIG. 4 shows the turnover of the various Zm-SHC-1 mutants compared with the wild type (wt) and the control without enzyme (K) with 25 mM squalene as substrate in the presence of 1% Triton. The percentage distribution of squalene and hopene after incubation for 70 h at 30° C. is shown in each case.

Clear changes in activity after mutation at position F486 are also seen with squalene as substrate. Interestingly, in this case the exchange of phenylalanine for tyrosine produces almost a doubling of the conversion (see FIG. 4).

Example 3: Activity Tests with Mutants of Other Squalene-Hopene Cyclases

The influence of various single mutations, produced according to example 1, in the sequence position corresponding to F486 on the cyclase activity of various other SHCs was determined for various citronellal substrates (in each case 20 mM overnight incubation):

The mutants are as follows:
Ap-SHC: F481C,
Bj-SHC: F447C,
Sc-SHC: F449C,
Zm SHC-2: F438C The phenylalanine residues are located in positions that are analogous to the F486 of Zm-SHC-1 (SEQ ID NO:2).

Figure 5:
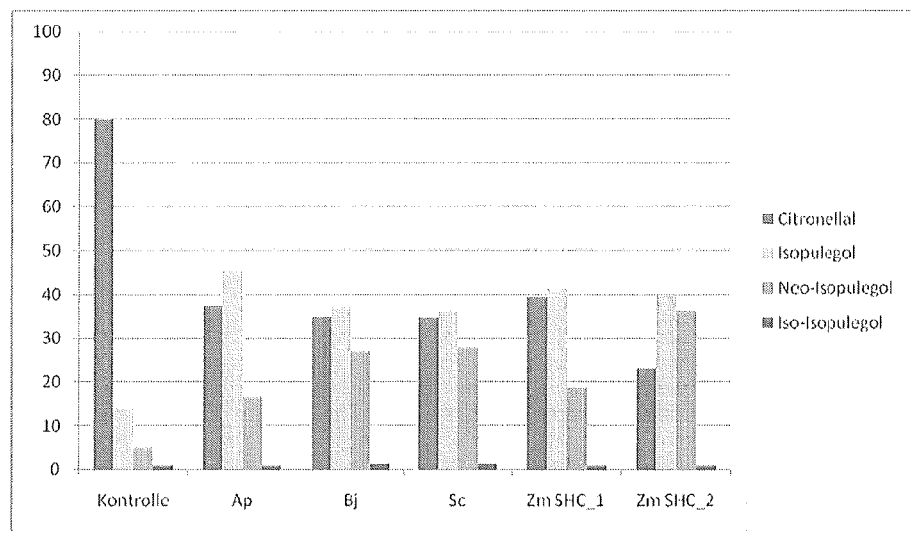
FIGS. 5 to 7 show the reaction of in each case 20 mM substrate after incubation overnight with the mutants Ap-SHC: F481C, Bj-SHC: F447C, Sc-SHC: F449C, Zm SHC-2: F438C and Zm SHC-1 compared with the control; the substrates were citronellal racemate in FIG. 5, R(+)-citronellal in FIG. 6 and S(−)-citronellal in FIG. 7.
Figure 6:
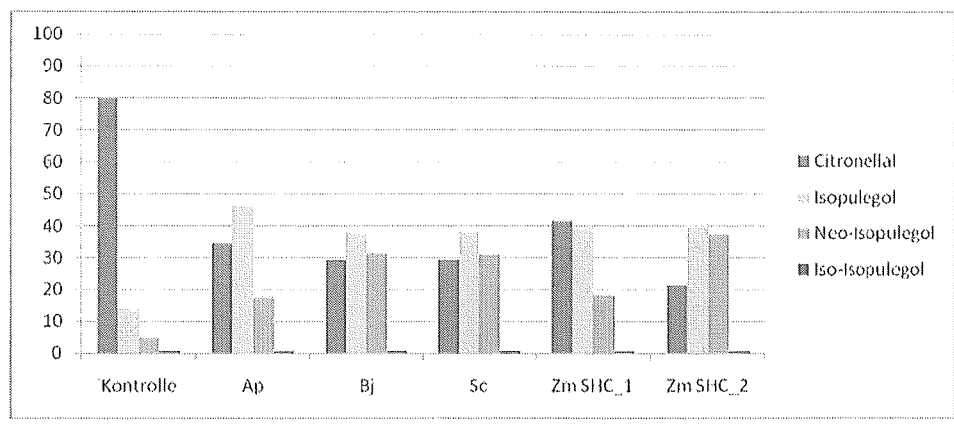
Figure 7:
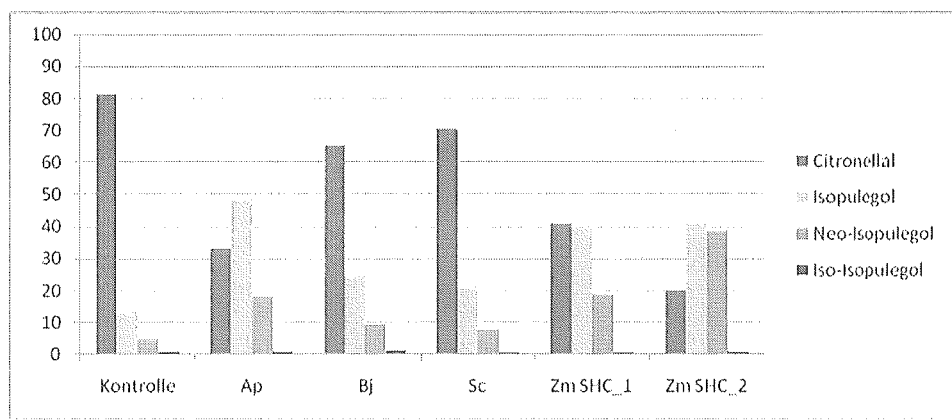

The results can be seen in FIG. 5 (citronellal racemate as substrate), FIG. 6 (R(+)-citronellal as substrate), and FIG. 7 (S(−)-citronellal as substrate). The control was a charge without active biocatalyst.

It can be seen that the wild-type enzymes, through mutation at the stated position corresponding to F486 (of Zm SHC-1), can now cyclize citronellal to isopulegol and moreover convert the R(+) form with increased selectivity compared with the S(−) form.

Example 4: Conversion of Compounds of Formula IV

These substances were converted under conditions corresponding to those employed for the conversion of citronellal as described above.

Example 5: Isolation and Characterization of the Squalene-Hopene Cyclase from *Zymomonas mobilis* (Zm-SHC)

International application PCT/EP2010/057696, hereby incorporated by reference, describes how, using specific oligonucleotides, the Zm-SHC gene from the genomic DNA of *Zymomonas mobilis* was amplified and expressed in *Escherichia coli*.

a) Material and Methods:

Addressed below are only materials and methods not mentioned in this form in international application PCT/EP2010/057696.

b) Strains, Plasmids and Culture Conditions:

The *E. coli* strain DH5α, the *E. coli* strain BL21 (DE3) pLysS (Novagen) and the *E. coli* Rosetta strain were used. The plasmid pET16b (Novagen) was used for cloning. For the overexpression of the SHC, moreover, the plasmid pLys-RAR62 was additionally transformed for the adaptation of the codon usage to *E. coli*. Furthermore, the plasmid pDHE+ ZmSHC-1 from *E. coli* Lu15568 was used (international application PCT/EP2010/057696). The strains were grown using LB medium at 30° C.

c) Chemicals:

Squalene, (+/−)-citronellal, (+)-R-citronellal and (−)-S-citronellal were purchased from Sigma (Sigma-Aldrich Chemie GmbH, Munich). Restriction enzymes, T4 ligase, and DNA polymerase came from New England Biolabs (New England Biolabs GmbH, Frankfurt).

d) Isolation of DNA and Transformation:

Plasmids were isolated from *E. coli* using the Qiaprep Spin Miniprep Kits from Qiagen (Qiagen, GmbH, Hilden). For gel extractions or PCR purifications, the Qiaquick Gel Extraction Kit from Qiagen was used. All of the *E. coli* strains used were transformed using the CaCl$_2$ method.

e) PCR and Sequencing:

The DNA from *Zymomonas mobilis* subspec. mobilis CP4 was provided by Prof. Sprenger (Institute of Microbiology. University of Stuttgart). The PCR was carried out using Prime Star Polymerase. The following primers were used for synthesizing the squalene-hopene cyclase gene from *Zymomonas mobilis*:

```
SHC_1:
SHC-for
                                    (SEQ ID NO: 387)
TATGCATATGGGTATTGACAGAAT SHC-rev
                                    (SEQ ID NO: 388)
CCGGATCCTCAATTATTCAAATCAATC
```

The correctness of the cloned genes was verified by means of sequencing by the company GATC Biotech. Sequence analyses were carried out using the program Clone Manager 7.0. After restriction of the corresponding amplificates, they were cloned in-frame into the pET16b vector using N-terminally encoded His-tag. The plasmids were subsequently transformed first in *E. coli* DH5α and thereafter in *E. coli* BL21 (DE3)pLysS and *E. coli* Rosetta. For better expression, the plasmid pLysRAR62 was transformed into the *E. coli* Rosetta strains in addition to the pET16b constructs. Corresponding clonings with empty vectors were carried out in parallel. In addition, the plasmid pDHE+ZmSHC_1 (corresponding to SHC_1 with codon usage adapted to *E. coli*) was transformed in *E. coli* BL21 (DE3)pLysS.

f) Expression and Cell Digestion:

The corresponding *E. coli* B121 (DE3) pLysS and *E. coli* Rosetta transformants were cultured in LB medium with ampicillin and chloramphenicol (100 μg/ml and 32 μg/ml, respectively) at 30° C. The synthesis of the squalene-hopene cyclases was induced by addition of 0.5-1 mM IPTG or 0.1% rhamnose (when using the pDHE derivatives) with an $OD_{600}$ of 0.4-0.6. The cells were allowed to grow further for 4-6 hours, and subsequently harvested. This was done by centrifuging off the cells and taking them up in 5 ml/g wet weight of 25 mM Tris/HCl with 40% glycerol. If the cells were not used further immediately, they were stored at −20° C. For digestion of the cells, they were each subjected 2× to a French Press and used, either directly or following removal of the cell debris by centrifugation, for the activity assays. Alternatively, cell digestion took place using ultrasound. Following centrifugation, the SHC proteins were subsequently dissolved with solubilization buffer (50 mM Tris/HCl pH 8, 10 mM $MgCl_2$, 1% Triton X-100) to remove the cell debris, and hence partially enriched.

g) Activity Assays:

Each batch for determining the activity of the squalene-hopene cyclases had a final volume of 1 ml. This was made up of 600 μl of cells digested by French Press (alternatively 800 μl after solubilization from the cell membrane), 100 mM Na citrate buffer with different pH levels (pH 4.0 to pH 8.0 were used for testing) and 10 mM substrate solution [(+/−)citronellal, (+)-R-citronellal and (−)-S-citronellal]. In addition to the substrate and $H_2O$, the substrate solution also comprised Triton X-100, which was present in each of the activity batches at a concentration of 0.2%.

The batches were incubated with shaking for 6 hours to 24 hours at temperatures of 22° C., 30° C. and 37° C. The substrate and possible products were extracted with one volume of chloroform hexane/propanol in a ratio of 2:3. The extract was used directly for analysis by gas chromatography.

h) GC Measurements:

The gas-chromatographic measurements took place on an Agilent 7890A gas chromatograph with flame ionization detector. The column used was a DB-5 (Agilent Technologies) with a length of 20 m, a diameter of 0.1 mm and 0.25 μM coating. Substances were identified by comparison of the retention times with available standard solutions.

For verification, the samples were analyzed in parallel on a Shimadzu Gas chromatograph with mass spectrometer. Using the column FS Supreme with a length of 30 m, an internal diameter of 0.25 mm and a coating of 0.25 μm, the retention times were again compared with standard solutions, and the respective mass spectra of the substances present were analyzed.

With the aid of a standard, the diastereomer identified below as isopulegol I was assigned to (1R,3R,6S) or (1S,3S,6R) isopulegol, whereas no assignment was possible for the isomers identified as isopulegol II and isopulegol III.

i) Results of the Activity Assays:

Test 1a: (comparative) (controls i.e. results with boiled-off protein, with empty vector and without protein)

|  | pH 4.0 | pH 4.5 | pH 5.0 | pH 5.5 | pH 6.0 | pH 6.5 | pH 7.0 |
|---|---|---|---|---|---|---|---|
| Citronellal | 85.4 | 85.4 | 86.0 | 85.6 | 84.4 | 84.7 | 85.1 |
| Isopulegol I | 10.8 | 10.8 | 10.4 | 10.8 | 11.7 | 11.5 | 11.2 |
| Isopulegol II | 3.8 | 3.8 | 3.6 | 3.6 | 3.9 | 3.8 | 3.7 |
| Isopulegol III | 0 | 0 | 0 | 0 | 0 | 0 | 0 |

In the information below concerning the substrate rac-citronellal, take place with the amounts of isopulegol found in the controls having already been deducted.

2. Test 1b: Comparison of the two overexpressed SHC_1 proteins (from pDHE and pET16b vector and influence of the His-tag on activity at pH 4.5)

|  | pDHE | pET16b |
|---|---|---|
| Citronellal | 95.2 | 95.2 |
| Isopulegol I | 0.7 | 0.8 |
| Isopulegol II | 1.7 | 1.6 |
| Isopulegol III | 2.4 | 2.4 |

3. Test 1c: pH dependence

|  | pH 4.0 | pH 4.5 | pH 5.0 | pH 5.5 | pH 6.0 | pH 6.5 | pH 7.0 |
|---|---|---|---|---|---|---|---|
| Citronellal | 95.9 | 94.9 | 94.7 | 94.4 | 95.1 | 98.7 | 98.8 |
| Isopulegol I | 0.4 | 0.8 | 0.8 | 1.0 | 1.1 | 0.8 | 0.5 |
| Isopulegol II | 1.1 | 2.4 | 2.1 | 2.1 | 1.6 | 0.5 | 0.7 |
| Isopulegol III | 2.6 | 1.9 | 2.4 | 2.5 | 2.2 | 0 | 0 |

4. Test 1d: Influence of salts at pH 4.5

|  | none | $BaCl_2$ | $CaCl_2$ | $MgCl_2$ |
|---|---|---|---|---|
| Citronellal | 94.9 | 95.2 | 94.9 | 95.0 |
| Isopulegol I | 0.7 | 0.8 | 1.0 | 0.9 |
| Isopulegol II | 2.5 | 2.4 | 2.4 | 2.5 |
| Isopulegol III | 1.9 | 1.6 | 1.7 | 1.6 |

5. Test 1e: influence of temperature at pH 4.5

|  | 22° C. | 30° C. | 37° C. |
|---|---|---|---|
| Citronellal | 95.3 | 94.9 | 95.4 |
| Isopulegol I | 0.8 | 1.0 | 0.8 |
| Isopulegol II | 1.8 | 2.2 | 1.6 |
| Isopulegol III | 2.1 | 1.9 | 2.2 |

6. Test 2: S(−)-Citronellal as substrate

|  | pH 4.0 | CTRL | pH 4.5 | CTRL | pH 5.0 | CTRL | pH 5.5 | CTRL |
|---|---|---|---|---|---|---|---|---|
| Citronellal | 90.8 | 95.5 | 90.8 | 95.7 | 91.7 | 96.2 | 92.4 | 96.2 |
| Isopulegol I | 4.9 | 4.5 | 4.7 | 4.3 | 4.4 | 3.8 | 4.1 | 3.8 |
| Isopulegol II | 0 | 0 | 0 | 0 | 0 | 0 | 0 | 0 |
| Isopulegol III | 4.3 | 0 | 4.5 | 0 | 3.9 | 0 | 3.5 | 0 |

|  | pH 6.0 | CTRL | pH 6.5 | CTRL | pH 7.0 | CTRL |
|---|---|---|---|---|---|---|
| Citronellal | 94.1 | 96.6 | 96.4 | 96.5 | 96.5 | 96.4 |
| Isopulegol I | 3.8 | 3.4 | 3.6 | 3.5 | 3.5 | 3.6 |
| Isopulegol II | 0 | 0 | 0 | 0 | 0 | 0 |
| Isopulegol III | 2.1 | 0 | 0 | 0 | 0 | 0 |

7. Test 3: R-(+)-Citronellal as substrate

|  | pH 4.0 | CTRL | pH 4.5 | CTRL | pH 5.0 | CTRL | pH 5.5 | CTRL |
|---|---|---|---|---|---|---|---|---|
| Citronellal | 80.0 | 84.2 | 78.4 | 83.8 | 81.1 | 85.6 | 81.7 | 86.8 |
| Isopulegol I | 15.9 | 15.8 | 16.0 | 16.2 | 14.1 | 14.4 | 13.5 | 13.2 |
| Isopulegol II | 4.1 | 0 | 5.6 | 0 | 4.8 | 0 | 4.8 | 0 |
| Isopulegol III | 4.3 | 0 | 4.5 | 0 | 3.9 | 0 | 3.5 | 0 |

|  | pH 6.0 | CTRL | pH 6.5 | CTRL | pH 7.0 | CTRL |
|---|---|---|---|---|---|---|
| Citronellal | 81 | 85.5 | 80.8 | 85.8 | 81.4 | 86.2 |
| Isopulegol I | 14.3 | 14.5 | 14.5 | 14.2 | 14.0 | 13.8 |
| Isopulegol II | 4.7 | 0 | 4.7 | 0 | 4.6 | 0 |
| Isopulegol III | 2.1 | 0 | 0 | 0 | 0 | 0 | j) Summary of the Results:

The squalene-hopene cyclase from *Zymomonas mobilis* was prepared recombinantly in *E. coli*. The enzyme is able to convert citronellal to isopulegol.

Here, the two overproduced Zm-SHC-1 proteins, once without and once with N-terminally appended His-tag, showed no differences in their activity under the conditions tested (cf. Test 1b).

This reaction was verified after 12 hours with the techniques described. The dependence of the reaction on the pH level was low. In a pH range from pH 4 to pH 6, conversion rates totaling about 5% were measured for different isopulegol isomers after 20-hour incubation.

Here it was not critical whether the batches were incubated at RT, 30° C. or 37° C. The conversion was also not increased by addition of divalent ions, such as $MgCl_2$; for example (cf. Test 1d). What was critical, however, was that the cell extracts, in the case of measurements above a pH of pH 5, either were dialyzed before the substrate was added, or EDTA was added to the batches, in order to suppress reduction of the citronellal substrate to citronellol by enzymes of the host. No effect of this treatment on the activity of the Zm-SHC-1 was found. Where this treatment was not carried out, the substrate was reduced almost completely to citronellol within 20 hours, and there was no longer any measurable cyclization to isopulegol. Zm-SHC-1 is therefore able to cyclize citronellal, but not citronellol, to isopulegol. It is very likely that unspecific dehydrogenases are responsible for the reduction reaction.

In order to rule out a chemical reaction being responsible for the cyclization, boiled-off cell extracts were used. In these controls and in controls with cell extracts from cultivation with empty vectors, however, no corresponding conversion was found (cf. Test 1a).

With (+/−)-citronellal as the substrate it was possible, following the reaction, to detect various isomers of isopulegol, which have not yet been precisely identified (cf. Tests 2 and 3). In order to verify whether these isomers originated from the different isomers of the starting substrate or if only one isomer was accepted as the substrate and was differently converted, the same studies were carried out with (+)-R-citronellal and (−)-S-citronellal. Here it was found that, depending on the substrate, different isopulegol isomers are formed. Interestingly, the conversion of (+)-R-citronellal took place from a pH of 4 to a pH of 7 without substantial differences, at a rate of about 5%. The enantiomer, in contrast, was converted with conversion rates of approximately 4.5% only up to a pH level of pH 6. Here as well, the conversion rate showed virtually no fluctuation in terms of the individual pH levels between pH 4 and pH 6.

Sequences:

SEQ ID NO: 1-326 nucleic acid/amino acid sequences of various SHC genes SEQ ID NO: 327-388 PCR primers The disclosure of the publications cited herein is expressly referred to.

There follows a listing of SHC enzyme sequences which can be used in accordance with the invention:

Enzyme Sequences

>seq_ID 4
MNMASRFSLKKILRSGSDTQGTNVNTLIQSGTSDIVRQKPAPQEPADLSALKAMGNSLTHTLSS
ACEWLMKQQKPDGHWVGSVGSNASMEAEWCLALWFLGLEDHPLRPRLGKALLEMQRPDGS
WGTYYGAGSGDINATVESYAALRSLGYAEDDPAVSKAAAWIISKGGLKNVRVFTRYWLALIGE
WPWEKTPNLPPEIIWFPDNFVFSIYNFAQWARATMMPLAILSARRPSRPLRPQDRLDALFPGG
RANFDYELPTKEGRDVIADFFRLADKGLHWLQSSFLKRAPSREAAIKYVLEWIIWHQDADGGW
GGIQPPWVYGLMALHGEGYQFHHPVMAKALDALNDPGWRHDKGDASWIQATNSPVWDTML
SLMALHDANAEERFTPEMDKALDWLLSRQVRVKGDWSVKLPNTEPGGWAFEYANDRYPDTD
DTAVALIAIASCRNRPEWQAKGVEEAIGRGVRWLVAMQSSCGGWGAFDKDNNKSILAKIPFCD
FGEALDPPSVDVTAHVLEAFGLLGLPRDLPCIQRGLAYIRKEQDPTGPWFGRWGVNYLYGTGA
VLPALAALGEDMTQPYISKACDWLINCQQENGGWGESCASYMEVSSIGHGATTPSQTAWALM
GLIAANRPQDYEAIAKGCRYLIDLQEEDGSWNEEEFTGTGFPGYGVGQTIKLDDPAISKRLMQG
AELSRAFMLRYDLYRQLFPIIALSRASRLIKLGN >seq_ID 2
MGIDRMNSLSRLLMKKIFGAEKTSYKPASDTIIGTDTLKRPNRRPEPTAKVDKTIFKTMGNSLNN
TLVSACDWLIGQQKPDGHWVGAVESNASMEAEWCLALWFLGLEDHPLRPRLGNALLEMQRE
DGSWGVYFGAGNGDINATVEAYAALRSLGYSADNPVLKKAAAWIAEKGGLKNIRVFTRYWLALI
GEWPWEKTPNLPPEIIWFPDNFVFSIYNFAQWARATMVPIAILSARRPSRPLRPQDRLDELFPE
GRARFDYELPKKEGIDLWSQFFRTTDRGLHWVQSNLLKRNSLREAAIRHVLEWIIRHQDADGG
WGGIQPPWVYGLMALHGEGYQLYHPVMAKALSALDDPGWRHDRGESSWIQATNSPVWDTM
LALMALKDAKAEDRFTPEMDKAADWLLARQVKVKGDWSIKLPDVEPGGWAFEYANDRYPDTD
DTAVALIALSSYRDKEEWQKKGVEDAITRGVNWLIAMQSECGGWGAFDKDNNRSILSKIPFCD
FGESIDPPSVDVTAHVLEAFGTLGLSRDMPVIQKAIDYVRSEQEAEGAWFGRWGVNYIYGTGA
VLPALAAIGEDMTQPYITKACDWLVAHQQEDGGWGESCSSYMEIDSIGKGPTTPSQTAWALM
GLIAANRPEDYEAIAKGCHYLIDRQEQDGSWKEEEFTGTGFPGYGVGQTIKLDDPALSKRLLQG
AELSRAFMLRYDFYRQFFPIMALSRAERLIDLNN >seq_ID 5
MTVTSSASARATRDPGNYQTALQSTVRAAADWLIANQKPDGHWVGRAESNACMEAQWCLAL
WFMGLEDHPLRKRLGQSLLDSQRPDGAWQVYFGAPNGDINATVEAYAALRSLGFRDDEPAVR
RAREWIEAKGGLRNIRVFTRYWLALIGEWPWEKTPNIPPEVIWFPLWFPFSIYNFAQWARATLM
PIAVLSARRPSRPLPPENRLDALFPHGRKAFDYELPVKAGAGGWDRFFRGADKVLHKLQNLGN
RLNLGLFRPAATSRVLEWMIRHQDFDGAWGGIQPPWIYGLMALYAEGYPLNHPVLAKGLDALN
DPGWRVDVGDATYIQATNSPVWDTILTLLAFDDAGVLGDYPEAVDKAVDWVLQRQVRVPGDW
SMKLPHVKPGGWAFEYANNYYPDTDDTAVALIALAPLRHDPKWKAKGIDEAIQLGVDWLIGMQ
SQGGGWGAFDKDNNQKILTKIPFCDYGEALDPPSVDVTAHIIEAFGKLGISRNHPSMVQALDYI
RREQEPSGPWFGRWGVNYVYGTGAVLPALAAIGEDMTQPYIGRACDWLVAHQQADGGWGE
SCASYMDVSAVGRGTTTASQTAWALMALLAANRPQDKDAIERGCMWLVERQSAGTWDEPEF
TGTGFPGYGVGQTIKLNDPALSQRLMQGPELSRAFMLRYGMYRHYFPLMALGRALRPQSHS >seq_ID 78
MTLTSSASARAPRDPGNYQTALQSTVRAAADWLIANQKPDGHWVGRAESNACMEAQWCLAL
WFMGLEDHPLRKRLGQSLLDTQRPDGAWQVYFNAPNGDINATVEAYAALRSLGYPDSEPAVR
RAREWIEAKGGLRNIRVFTRYWLALIGEWPWEKTPNIPPEVIWFPLWFPFSIYNFAQWARATLM Enzyme Sequences PIALLSARRPSRPLPPENRLDTLFPRGRDAFDYELPVKANAGGWDKFFRGADKVLHALQNFGN
RLNLGLFRPAATSRVLEWMIRHQDFDGAWGGIQPPWIYGLMALYAEGYPLNHPVLAKGLDALN
DPGWRVDVGEATYIQATNSPVWDTILTLLAFDDAGVLGDYPDAVDKAVNWVLARQVRVPGDW
SMKLPHVKPGGWAFEYANNHYPDTDDTAVALIALAPLRHDPKWKAKGIDEAIQLGVDWLIGMQ
SQGGGWGAFDKDNNQQILTKIPFCDYGEALDPPSVDVTAHIVEAFGKLGISRNHPSMVQALDYI
RKEQEPSGPWFGRWGVNYVYGTGAVLPALAAIGEDMTQPYIGRACDWLVAHQQPDGGWGE
SCASYMDISAVGRGTTTASQTAWALMALLAANRPQDKDAIERGCMWLVERQSAGTWDEPEFT
GTGFPGYGVGQTIKLTDPSLQERLMQGPELSRAFMLRYGMYRHYFPLMALGRALRPQGHG >seq_ID 209
MDSILAPRADAPRNIDGALRESVQQAADWLVANQKPDGHWVGRAETNATMEAQWCLALWFL
GLEDHPLRVRLGRALLDTQRPDGAWHVFYGAPNGDINATVEAYAALRSLGHRDDEEPLRKAR
DWILSKGGLANIRVFTRYWLALIGEWPWEKTPNILPEVIWLPTWFPFSIYNFAQWARATLMPIAV
LSAHRPSRPLAPQDRLDALFPQGRDSFNYDLPARLGAGVWDVIFRKDTILHRLQDWGARRGP
HGIMRRGAIDHVLQWIIRHQDYDGSWGGIQPPWIYGLMALHTEGYAMTHPVMAKALDALNEPG
WRIDIGDATFIQATNSPVWDTMLSLLAFDDAGLGERYPEQVERAVRWVLKRQVLVPGDWSVKL
PDVKPGGWAFEYANNFYPDTDDTSVALMALAPFRHDPKWQAEGIEDAIQRGIDWLVAMQCKE
GGWGAFDKDNDKKILAKIPFCDFGEALDPPSADVTAHIIEAFAKVGLDRNHPSIVRALDYLKREQ
EPEGPWFGRWGVNYVYGTGAVLPALAAIGEDMRQPYIARACDWLIARQQANGGWGESCVSY
MDAKQAGEGTATASQTAWALMALIAADRPQDRDAIERGCLYLTETQRDGTWQEVHYTGTGFP
GYGVGQTIKLNDPLLSKRLMQGPELSRSFMLRYDLYRHYFPMMAIGRVLRQRGDRSGH >seq_ID 193
MNVIRQLNSGVNAAKSLDDGIESAIEWLAENQDKEGFMVGMLESNSCIEAEWILAMHLLGVKD
DPKYDKVVQAILNEQREDGSWAVYYDAPAGDINATVEAYAALRTAGFGAGDERLIKARNWIFS
HGGLKNVRVFTRYWLALIGEWPWDETPALAPEIIYLPAWCPLNIYDFACWARATLVPLSVLSVR
RPVKPLPAESRLDELFPEGRENADYSLPESEKGLAERFFLVVDWFLKKYNRLPMQFGREKAIR
LCLEWIVRHQDYDGGWGGIQPPLIYSLIALNTEGYGINHPVISKGLDAFNPPWAYEKNGGVYLQ
CSESPVWDTLFTMLALFESGCSFDDTPMMRPALDWILSKQITSWGDWQVKVRGVRPGGWAF
ERANTAYPDVDDTALALVVLAEARRHVKDSAAVDAALERAEEWILGLQCRNGGWAAFDRDNN
SAIVTKIPFCDFGEVLDPPSVDVTAHVVEALAALGRDRHDPVVARALKYIRSEQEPGGSWFGR
WGVNHIYGTCAVLPALAAIGEDMRAPYVLRAADWLVRHQNDDGGWGESCASYMDDSQCGQ
GSSTASQTGWALMALVAMSSHDYDEAIRRGLDYLLSHQKSGTWDEPQYTGTGFPGYGVGER
TNLKEAGATLDQGCELARGFMINYNMYRHYFPLIAMARARRHLGLAANPRHQDSRSSVEVAPE
ALRGRACG >seq_ID 246
MRRLDTFPPEIPTGSRDKPPSGEEHSCSTPAEPLRSRLDEGILRAVDWLVCDQHPDGFWAGM
LQSNSCMEAEWVLAMHFLGIDDDPKYDGVIRAILGEQRADGSWGVFHKAPNGDINTTVECYAA
LRASGLAPESAPLSSAREWILAGGGLANIRNFTKYWLALIGEWPWEGTPTIPPELIFFPPRMPLN
IYHFASWARSTIVPLSILSARRPVRPLPEDRRLDELFPQGRSAFDFRLPRKDGWLSWEGFFHVC
DRILRLYARTRRAPFRETAIRVCLEWIIRRQETDGAWSGIQPPWIYALLALHAEGYGLDHPILRA
GLRAFDSHWSYERDGGIYLQASESPVWDTVLSLRALADCGEERKASVSIASALEWLLNRQISV

Enzyme Sequences

PGDWAVRVPSVPCGGWAFQRANSFYPDVDDTAVAIEVLARLRPFTANQSAVDRAIRSARDWV

LAMQCSNGGWAAFDRDNDFKLVTKIPFCDFGELLDPPSVDVTAHVIEALAALGWDMTSREIEA

AVSFIRREQEAEGSWFGRWGVNHIYGTATVLPALRAIGEDMSSAYVLRAADWLASRQNADGG

WGETPASYMDDSLRGVGESTASQTAWAIMGLVAVGSGAHDDTVRRGIDFLLFAQHGGTWEE

PQYTGTGFPGYSVGERIRLRDMGASLKQGTELQRAFMINYNLYRHYFPLMALGRARYHLQLRR

SAREGGNGETTPNGSAL

>seq_ID 151
MKISKNPISHALTSFNDAARETADNSAARKSGKIHHLPATIWKKKESTVSSPLDIAIERTQEFFFR

EQLPAGYWWAELESNATITAEYIMLFHFMGLVNREKERKMANYLLRQQTTEGYWTIWHGGPG

DLSTTIEAYFALKLAGYPADHPSMSKARAFILEHGGILKARVFTKIFLALFGEFSWLGVPSMPIEM

MLLPAGFTFNMYEESSWSRATIIPLSIVMAERPVRKLPPWARVQELYVRPPRPTDYTFTKEDGIL

TWKNIFIGIDHVLKVYEASPIRPGRKKAMAIAEKWVLEHQEPTGDWGGIQPAMLNSVLALHVLG

YANDHPAVAKGLQALANFCIEGEDELVLQSCVSPVWDTALGLMAMVDSGVPTDHPSLSKAAQ

WLLDREVRRPGDWKIKCPDLEPGGWAFEFMNDWYPDVDDSGIVMMAIKNVKVKDQRAKEDTI

TRGIAWCLGMQSKNGGWGAFDKDNTKHILNKIPFADLEALIDPPTADLTGRMLELMGTYGYPK

DHPAAVRALKFIRETQEPDGPWWGRWGVNYIYGTWSVMSGLAAFGEDMSQPWIRKAVDWLV

EHQNEDGGWGECCESYADPRLAGVPSTASQTGWALLTLLAAGEVASSSVVRGVQYLLDTQ

KPDGTWDEDAFTGTGFPKFFMIKYHIYRNCFPLMALGRYRTLAGKGL

MKSRKYPISHALTSFNHTTVAPVEAPAPISVKSPAKVHRLPSSIWKKMEGSAGNPLDKAVELTR

DFFFREQLPDGYWWAELESNVTITAEYIMLFHFLGMVDKDKERKMANYLLRQQTEEGYWTVW

HNGPGDLSTTIEAYFALKLAGYHADHIALRKARDFILANGGILKSRVFTKTFLAMFGEFSWLGVP

SMPIELMLLPDWAYLNVYEFSSWARATIIPMSVLMANRPVYKLPPHARVQELYVRPPRPTDYTF

TKEDGIFSLKNFFIGVDHLLKIYESSPIRPFKKRATEKVEQWILEHQEKTGDWGGIQPAMLNAILA

LHCLGYANDHPAVAKGLEALANFTIEDSDSLVLQSCISPVWDTALVLQAMQEASVPLDHPSLIK

ASQWLLDREVRIKGDWKIKSPDLEPGGWAFEFQNDWYPDVDDSTAVMIAIKDIKVKNTKARQD

AIRRGIDWCLGMQSENGGWAAFDKDNTKHMLNKIPFADLEALIDPPTADLTGRMLELMGNFGY

TKDHPQAVSALEFLKNEQEPEGPWFGRWGVNYIYGTWYVLIGLEAIGEDMNSPYIKKSVNWIK

SRQNLDGGWGEVCDSYWDRTLMGCGPSTASQTSWALMALMAAGEVGCQAVERGIQYLLAT

QNSDGTWDEEAFTGTGFPKYFMIKYHIYRNCFPLTALGRYRRLTAGTHAQ

>seq_ID 152
MNSCKHPISHALTSFNGETADAAKKQPVKPGAKIHHLPASIWKKKEGESKSPLDIAIENSRDFFF

REQLPDGYWWAELESNCTITAEYLMLYHFMGIVDQERERKMATYLLSKQTAEGFWTIYFGGPG

DLSTTVEAYFALKLAGYPADHPAMAKARAFILDNGGIIKCRVFTKIFLALFGEFAWFGVPSMPIEL

ILLPNWAYFNMYELSSWSRATIIPLSIVMTERPVRKLPPSRVQELYVRPPRPIDYTFSKEDGIIT

WKNFFIGVDHILKVYESNPIRPFKKRALATAENWVLDHQESTGDWGGIQPAMLNSVLALHCLG

YANDHPAVAKGLEALANFCIETEDSLVLQSCISPIWDTALALKALVDSDVPTDHPALVKAAQWLL

DKEVRKPGDWKIKCPELESGGWAFEFLNDWYPDVDDSGFVMMALKDVAVKDRKSMDGAIKR

GINWCLGMQSKNGGWGAFDKDNTKYLLNKIPFADLEALIDPPTADLTGRMLELMGTFGYSKDY

PAAVRALEFIKKNQEPEGSWWGRWGVNYIYGTWSVLGGLAAIGEDLNQPYIRKAVNWLKSRQ

| Enzyme Sequences |
|---|
| NMDGGWGETCESYHDTSLAGIGESTPSQTGWALLSLMSAGEANSSTVARGIQYLIANQKSDG
TWDEEQYTGTGFPKFFMIKYHIYRNCFPLTALGTYRKLTGGMA >seq_ID 146
MTSPFKHPISNALTSFNGNFAEPEQCVEQQTGAKVHHLPASIWKRKMGKAKSPLDVAIEGSRD
FFFQEQLPKGYWWAELESNVTITAEYIMLFHFLGLVDRERQRKMSNYLLSKQTEEGFWPIYYG
GPGDLSTTIEAYFALKLSGYPADHPALAKARAFILEQGGVVKSRVFTKIFLALFGEFEWQGVPS
MPVELNLLPDWAYINIYEFSSWARATIVPLSVVMHSRPVRRVPPSARVQELFVRQPTAADYSFA
KNDGIFTWENFFLGLDRVLKVYEKSPLRPFKNMALAKAEEWVLEHQEPTGDWGGIQPAMLNA
VLALNVLGYQNDHPAVEQGLRALANFCIETEDQLVLQSCVSPVWDTALALKALLDAGVPPDHP
SLVKGAQWLLDKEVTRPGDWRVKSPALEPGGWAFEFLNDWYPDVDDSGFVMIALKGIQVKDR
KSMDAAIKRGINWCLGMQSKNGGWGAFDKDNTRHVLNKIPFADLEALIDPPTADLTGRMLELM
GTFNYPITLPAAQRAIEFLKKNQEPEGPWWGRWGVNYLYGTWSVLCGLAAIGEDMDQPYIRKA
VNWIKSRQNIDGGWGETCQSYHDRTLAGVGESTPSQTGWALLGLLAAGEMHSATVVRGVQY
LISTQNSDGTWDEQQYTGIGFPKYFMIKYHIYRNCFPLMALGTYRTLTRTQP >seq_ID 147
MSPCKHPISHALTSFNGETADSVPVQTPKTGAKIHHLPPSIWKKKEGELKSPLDIAIENSRDFFF
REQLPDGYWWAELESNCTITAEYVMLYHFMDLVDRERERKMANYLLSKQTEEGFWTIYYGGP
GDLSTTVEAYFALKLAGYPADHPAMVKARAFILDNGGIIKTRVFTKIFLALFGEFAWFGVPSMPIE
LILLPNWAYFNMYELSSWSRATIIPLSIVMTQRPVRKLPPASRVQELYVRPPSPIDYTFTKEDGIF
TWKNFFIGVDHILKVYESNPIRPFKKKAMLAAENWVLEHQEATGDWGGIQPAMLNSVLALHCL
GYANNHPAVAKGLEALENFCIESEDSLVLQSCISPVWDTALALKALVDSDVPNDHPALVKAAQ
WLLDKEIRKAGDWKVKSPELEPGGWAFEFLNDWYPDVDDSGFVMMALKDVAVKDRKSMDTAI
KRGISWCLGMQSKNGGWGAFDKDNTKYLLNKIPFADLEALIDPPTVDLTGRMMELMGTFGYAK
DYPPAVRALDFIKRNQEPDGSWWGRWGVNYIYGTWSVLCGLSAMGEDLNQPYIRKAINWLKS
RQNIDGGWGETCESYHDSSLAGIGASTASQTGWALLALMAVGEENASAVARGVQYLLATQKS
DGTWDEDLYTGTGFPKFFMIKYHIYRNCFPLTALGTYRRKTGGRAEMQVSEHNK >seq_ID 144
MKISKHPISHALTSFNETAKETKEEPQKKRGGKVHHLPASIWKKRDVETTSPLDQAIKRSQEFFL
REQLPAGYWWAELESNVTITAEYVILFHFMGLVNRDKDRKMATYLLSKQTEEGCWCIWHGGP
GDLSTTIEAYFALKLAGYPADHPAMQKARTFILGKGGILKARVFTKIFLALFGEFSWLGVPSMPIE
MMLLPNGFTFNLYEFSSWSRATIIPLSIVMAERPVRKLPPWARVQELYVRPPRPMDYTFTKEDG
ILTWKNIFIGIDHILKVYEASPIRPGMKKAMAIAEQWVLDHQEPTGDWGGIQPAMLNSVLALHCL
GYANDHPAVAKGLQALANFCIESDDEIVLQSCISPVWDTALALMAMVDSEVPTDHPALVKAAQ
WLLDREVRKVGDWKIKAPNLEPGGWAFEFQNDWYPDVDDSGIVMMAIKDVKVKDSKAKAEAI
QRGIAWCIGMQSKNGGWGAFDKDNTKHILNKIPFADLEALIDPPTADLTGRMLELMGTFGYPK
DHPAAVRALQFVKENQEPDGPWWGRWGVNYIYGTWSVLCGLKAYGEDMGQPYVRKAVEWL
AAHQNPDGGWGECCESYCDQKLAGTPSTASQTGWALLSMLAAGDVDHPAVARGIRYLIETQ
QPDGTWDEDQFTGTGFPKYFMIKYHIYRNCFPLMAMGRYRALKGHKG >seq_ID 15
MAEQLVEAPAYARTLDRAVEYLLSCQKDEGYWWGPLLSNVTMEAEYVLLCHILDRVDRDRME
KIRRYLLHEQREDGTWALYPGGPPDLDTTIEAYVALKYIGMSRDEEPMQKALRFIQSQGGIESS |

| Enzyme Sequences |
| --- |
| RVFTRMWLALVGEYPWEKVPMVPPEIMFLGKRMPLNIYEFGSWARATVVAISIVMSRQPVFPL |
| PERARVPELYDTDVPPRRRGAKGGGGRIFDALDRALHGYQKLSVHPFRRAAEIRALDWLLERQ |
| AGDGSWGGIQPPWFYTLIALKILDMTQHPAFIKGWEGLELYGVDLDYGGWMFQASISPVWDT |
| GLAVLALRAAGLPADHDRLVKAGEWLLDRQITVPGDWAVKRPNLKPGGFAFQFDNVYYPDVD |
| DTAVVVWALNSLRLPDERRRRDVMTKGFRWIVGMQSSNGGMGAYDVDNTSDLPNHIPFCDF |
| GEVTDPPSEDVTAHVLECFGSFGYDDAWKVIRRAVEYLKREQRPDGSWFGRWGVNYLYGTG |
| AVVPALKAVGIDVREPFIQKALDWVEQHQNPDGGWGEDCRSYEDPAYAGKGASTPSQTAWA |
| LMALIAGGRAESDSVRRGVQYLVETQRPDGGWDEPYYTGTGFPGDFYLGYTMYRHVFPTLAL |
| GRYKQAIERR |
| |
| >seq_ID 16 |
| MAEQLVEAPAYARTLDRAVEYLLSCQKDEGYWWGPLLSNVTMEAEYVLLCHILDRVDRDRME |
| KIRRYLLHEQREDGTWALYPGGPPDLDTTIEAYVALKYIGMSRDEEPMQKALRFIQSQGGIESS |
| RVFTRMWLALVGEYPWEKVPMVPPEIMFLGKRMPLNIYEFGSWARATVVALSIVMSRQPVFPL |
| PERARVPELYETDVPPRRRGAKGGGGWIFDALDRALHGYQKLSVHPFRRAAEIRALDWLLER |
| QAGDGSWGGIQPPWFYALIALKILDMTQHPAFIKGWEGLELYGVELDYGGWMFQASISPVWD |
| TGLAVLALRAAGLPADHDRLVKAGEWLLDRQITVPGDWAVKRPNLKPGGFAFQFDNVYYPDV |
| DDTAVVVWALNTLRLPDERRRRDAMTKGFRWIVGMQSSNGGWGAYDVDNTSDLPNHIPFCD |
| FGEVTDPPSEDVTAHVLECFGSFGYDDAWKVIRRAVEYLKREQKPDGSWFGRWGVNYLYGT |
| GAVVSALKAVGIDTREPYIQKALDWVEQHQNPDGGWGEDCRSYEDPAYAGKGASTPSQTAW |
| ALMALIAGGRAESEAARRGVQYLVETQRPDGGWDEPYYTGTGFPGDFYLGYTMYRHVFPTLA |
| LGRYKQAIERR |
| |
| >seq_ID 141 |
| MTSPFKHPISNALTSFNGNVAEPEQSVEQQSGAKVHHLPASIWKRKMGRAKSPLDVAIEGSRD |
| FFFQEQLPKGYWWAELESNVTITAEYIMLFHFLGLVDPERQRKMSTYLLSKQTEEGFWTIYYG |
| GPGDLSTTIEAYFALKLSGYPEDHPALAKARAFILEQGGVVKSRVFTKIFLALFGEFDWQGIPSM |
| PVELNLLPDWAYINIYEFSSWARATIVPLSVVMHSRPVRRVPPSARVQELFVRQPTAADYSFAK |
| NDGLFTWEKFFLGLDRVLKVYEKSPLRPFKKTALAKAEEWVLEHQEPTGDWGGIQPAMLNAIL |
| ALNVLGYRNDHPAVEQGLRALANFCIETEDQLVLQSCVSPVWDTALALKALLDAGVPPDHPSL |
| VKGAQWLLDKEVTRAGDWRVKSPNLEAGGWAFEFLNDWYPDVDDSGFVMIALKGIQVKDHK |
| AMDAAIKRGINWCLGMQSKNGGWGAFDKDNTKHVLNKIPFADLEALIDPPTADLTGRMLELMG |
| TFDYPVTFPAAQRAIEFLKKNQEPEGPWWGRWGVNYLYGTWSVLCGLAAIGEDMDQPYIRKA |
| VNWIKSRQNIDGGWGETCQSYHDRTLAGVGESTPSQTGWALLSLLAAGEMHSATVVRGVQYL |
| ISTQNSDGTWDEQQYTGTGFPKYFMIKYHIYRNCFPLMALGTYRTLTRTQP |
| |
| >seq_ID 195 |
| MNPAKYKISSSLTSLNAEPVEQAPLPAKRTGSKVHRLPPSIWKKMVAEAKSPLDKGIERTRDFF |
| LREQLPDGYWWAELESNVTISAEYVMLFHFLGMVDRERERKLANYILAKQTSEGFWSLWHNG |
| PGDLSTTIEAYFALKLAGYSADHPAMAKARAFVLANGGIIKARVFTKIFLALFGEFAWFGVPSMPI |
| ELMLLPDWAYFNMYEFSSWSRATIIPLSVVMSERPVRKLPPRAQVQELFVRPPRPTDYTITRED |
| GLFTWKNFFIGADHLIKVYESSPIRPFKKRAVALAENWILEHQEQSGDWGGIQPAMLNSILALHC |
| LGYANDHPAVAKGLDALANFCIEDDDCIVLQSCVSPVWDTALALVALQEADVPADHPALVKAA |

| Enzyme Sequences |
|---|
| QWLLNLEVRRKGDWQVKCPELEPGGWAFEFLNDWYPDVDDSGFVMLSIKNIKVRDRKHREE |
| AIKRGIAWCLGMQSENGGWGAFDRNNTKYLLNKIPFADLEALIDPPTADLTGRMLELMGNFDY |
| PKSHPAAERALAFLKKEQESEGPWWGRWGVNYLYGTWSVLCGLEAIGEDMNQPYIRKAVNWI |
| KSRQNNDGGWGEVCESYFDRSLMGSGPSTASQTGWALLALMAAGEANSRAAAQGVKYLLET |
| QNEDGTWDEDAFTGTGFPKFFMIKYHIYRNCFPLTALGRYRRLTAAKG |
| >seq_ID 3 |
| MTATTDGSTGASLRPLAASASDTDITIPAAAAGVPEAAARATRRATDFLLAKQDAEGWWKGDL |
| ETNVTMDAEDLLLRQFLGIQDEETTRAAALFIRGEQREDGTWATFYGGPGELSTTIEAYVALRL |
| AGDSPEAPHMARAAEWIRSRGGIASARVFTRIWLALFGWWKWDDLPELPPELIYFPTWVPLNI |
| YDFGCWARQTIVPLTIVSAKRPVRPAPFPLDELHTDPARPNPPRPLAPVASWDGAFQRIDKALH |
| AYRKVAPRRLRRAAMNSAARWIIERQENDGCWGGIQPPAVYSVIALYLLGYDLEHPVMRAGLE |
| SLDRFAVWREDGARMIEACQSPVWDTCLATIALADAGVPEDHPQLVKASDWMLGEQIVRPGD |
| WSVKRPGLPPGGWAFEFHNDNYPDIDDTAEVVLALRRVRHHDPERVEKAIGRGVRWNLGMQ |
| SKNGAWGAFDVDNTSAFPNRLPFCDFGEVIDPPSADVTAHVVEMLAVEGLAHDPRTRRGIQW |
| LLDAQETDGSWFGRWGVNYVYGTGSVIPALTAAGLPTSHPAIRRAVRWLESVQNEDGGWGE |
| DLRSYRYVREWSGRGASTASQTGWALMALLAAGERDSKAVERGVAWLAATQREDGSWDEP |
| YFTGTGFPWDFSINYNLYRQVFPLTALGRYVHGEPFAKKPRAADAPAEAAPAEVKGS |
| >seq_ID 18 |
| MTKQLLDTPMVQATLEAGVAHLLRRQAPDGYWWAPLLSNVCMEAEYVLLCHCLGKKNPEREA |
| QIRKYIISQRREDGTWSIYPGGPSDLNATVEAYVALKYLGEPASDPQMVQAKEFIQNEGGIEST |
| RVFTRLWLAMVGQYPWDKLPVIPPEIMHLPKSVPLNIYDFASWARATIVTLSYRHESPTCDATS |
| GLCKGSGIVRGEGPPKRRSAKGGDSGFFVALDKFLKAYNKWPIQPGRKSGEQKALEWILAHQ |
| EADGCWGGIQPPWFYALLALKCLNMTDHPAFVKGFEGLEAYGVHTSDGGWMFQASISPIWDT |
| GLTVLALRSAGLPPDHPALIKAGEWLVSKQILKDGDWKVRRRKAKPGGWAFEFHCENYPDVD |
| DTAMVVLALNGIQLPDEGKRRDALTRGFRWLREMQSSNGGWGAYDVDNTRQLTKSDSIFATS |
| GEVIDPPSEDVTAHVLECFGSFGYDEAWKVIRKAVEYLKAQQRPDGSWFGRWGVNYVYGIGA |
| VVPGLKAVGVDMREPWVQKSLDWLVEHQNEDGGWGEDCRSYDDPRLAGQGVSTPSQTAW |
| ALMALIAGGRVESDAVLRGVTYLHDTQRADGGWDEEVYTGTGFPGDFYLAYTMYRDILPVWA |
| LGRYQEAMQRIRG |
| >seq_ID 245 |
| MNPIRGKRGSAADFLEEEYQWENLADHGESGRTPGGGHPAALKEYEAGSATEHTGHHCVHH |
| LGVRNSWLRKIEKAIDNACGQLFKTQYEDGYWWSELESNVTITSEYIMLLYLLEVSRPEQQKSM |
| VKYLLNQQRPDGSWGLYYGDGGNLSTTIEAYFALKLAGEHCESEPMRRAREFILSKGGIESAR |
| VFTKIWLALFSQYDWDKVPSMPVELVLLPSSLYFNIYEFSSWARGTVVPLSIVMSIRPRCPLPAK |
| CSIKELYVPGSKHKNFASCTHKLFFLFDRIAKAFERRPVPSLRNKAVQAAETWVLDHQEDSGD |
| WGGIQPPMVYSVLALYYLGYPLDHEVIVKGIKALDAFCMEDEEGTRMQSCVSPVWDTALTVLS |
| MLDAGVAAEHPGLEKAGRWLLENQVLTGGDWQIKNDSLPGGWAFEFYNTRYPDVDDSAVVL |
| STLNRFNAERVEGLEFAKCRGMEWCLSMQSSNGGWAAFDKDNTLEILNRIPFADQEAMVDYP |
| TADVTGRVLEAMGYLGYDGSHPRARKAIQFLKKRQERDGCWWGRWGVNYIYGTWSVLKGLI |

Enzyme Sequences

SIGEDPRAAYIRAAVRWVKDHQNSDGGWGETCESYENPELRGQGPSTPSQTAWALMSLIACG

EMKSQEASRGIQYLLRTQKRDGTWEELHFTGTGFPKHFYIRYHNYRNCFPLMALGQYLRALER

>seq_ID 221
MTATTDGSTGALPPRAASASEPHDTIPQAAGSVGIQDAAARATQRATDFLLSRQDAEGWWKG

DLETNVTMDAEDLLLRQFLGIQDEKTTRAAGLFIRGEQRADGTWATFYGGPGDLSATIEAYVAL

RLAGDGPDEPHMAKASAWIRERGGIASARVFTRIWLALFGWWKWDDLPELPPELIYFPKWMP

LNIYDFGCWARQTIVPLTVVSAKRPVRPAPFPLDELHADANDPNPAKPLAPMVSWDGLFQRLD

VALHTYRKVAPRRLRKAAMNTAARWIIERQENDGCWGGIQPPAVYSVIALYLLGYDLEHPVMR

EGLASLDRFAVWRDDGARMIEACQSPVWDTCLATIALADAGVPADHPQLVRAADWMLGEEIV

RPGDWAVKRPQLPPGGWAFEFHNDNYPDIDDTAEVVLALRRVKHHDPERLDNAIRRGVRWNL

GMQSKDGGWGAFDVDNTSPFPNRLPFCDFGEVIDPPSADVTAHVVEMLAFEGLSHDPRTRR

GIQWLLSAQEANGSWFGRWGVNYVYGTGSVVPALVAAGLPASHPAIRRAVTWLETVQNDDG

GWGEDLRSYPEAAEWSGKGASTASQTGWALLALLAAGERESKAVERGIEWLAQTQRPDGSW

DEPYFTGTGFPWDFSINYHLYRQVFPLTALGRYVNGEPLVEVKGG

>seq_ID 160
MKGKEPTREELLSFSSGIQMDSSAENTTPVSTEELQEKVRLAAESLISRQVEEGYWVEPLEAD

VTITSEYILLQYLLGRERDEFFRRAAPFILESQGEDGGWPLYHGGPAEISATVKAYLALKLLGYD

ADHPAMQRARALVLERGGAINVNVFTRITLALFGQYDWKGVPALPPEMILLPRWFPLSIYTVSY

WSRTVIVPLLFIYHYKPLLELPPEKGVQELFITPMSEVRVHYAWDKHWVSWKNLFFVLDRILQA

WNRHPPSFLRRKALKKAMEWMIPRLKGEGGLGAIYPAMANSVLALRLEGYAMDHPLVRRAIQS

IDDLVFDLGEQQSVQPCHSPIWDTALALGALYEAGLDEGSPFVSRALDWFCRKEVRTVGDWS

VRVPGVEAGGWAFQFENDYYPDIDDTSVVLMDFAKWVPEMGAYRDVFRRAIEWTLSMQGTD

GGWGAFDKDNDFLFLNNIPFADHGALLDPSTSDVTGRVTELLGILGYDARTPVVRRALRFLRKE

QEENGSWYGRWGVNYIYGTWSVVSALKAVGEDMSAPYVQKAMQFLFSRQNPDGGWGESCY

SYFRKDTAGEGVSTSSQTAWALIALIHGGHVRHPAVSKGIDFLLSRQQADGKWLEQEYTGTGF

PKVFYLRYNMYRDYFSLWALSLYRNVLLDGQSRVERLARRWKGNPYPVRSRFLA

>seq_ID 161
MEGKDPTREELLSFTSGIQMDSRVGNTNPVSTEELQEKVRLAAESLISRQGEEGYWVEPLEAD

ITITSEYVLLQYLLGRERDEFFRRAAPFILESQGEDGGWPLYNGGPAEISATVKAYLALKLLGYD

ADHPAMQRARALVLERGGAINVNVFTRITLALFGQYDWKGVPALPPEMILLPRWFPLSIYTVSY

WSRTVIVPLLFIYHYKPLLELPPEKGVQELFITPMSEVRVHYAWDKHWVSWKNLFFVLDRILQA

WNRHPPSFLRRKALKKAMEWMIPRLKGEGGLGAIYPAMANSVLALRLEGYEMDHPLVRRAIQS

IDDLVFDLGEQQSVQPCHSPIWDTALALGALYEAGLDEGSPFVSRALDWFCRKEVRTVGDWS

VRVPGVEAGGWAFQFENDYYPDIDDTSVVLMDFAKWVPEMGAYRDVFRRAIEWTLSMQGTD

GGWGAFDKDNDFLFLNNIPFADHGALLDPSTSDVTGRVTELLGILGYDARTPVVRRALRFLRKE

QEENGSWYGRWGVNYIYGTWSVVSALKAVGEDMSAPYVQRAMQFLFSRQNPDGGWGESCY

SYFRKDTAGEGVSTASQTAWALIALIHGGHVRHPAVSKGIDFLLSRQQADGKWLEQEYTGTGF

PKVFYLRYNMYRDYFSLWALSLYRNVLLDGQSRVERLSRRWKGTPYPVRSRFLA

>seq_ID 240
MHEGEAMTATTDGSTGALPPRAAAASETHLDTPVAAGIQEAAVRAVQRATEHLLARQDAEGW

WKGDLETNVTMDAEDLLLRQFLGIRDESTTRAAAKFIRGEQREDGTWAGFYGGPGELSTTVEA

Enzyme Sequences

YVALRLDGDAPDAPHMAKASAWIRAQGGIAAARVFTRIWLALFGWWKWEDLPELPPELIYFPK
WAPLNIYDEGCWARQTIVPLTIVSAKRPVRPAPFPLDELHADPADPNPAKPLAPVASWDGAFQ
RLDKAMHQLRKVAPRRLRRAAMNSAARWIIERQENDGCWGGIQPPAVYSVIALHLLGYDLQHP
VMRAGLESLDRFAIWREDGSRMIEACQSPVWDTCLATIALVDAGVPADHPQLVKAADWMLGE
EIVRPGDWSVKRPQLPPGGWAFEFHNDNYPDIDDTAEVVLALRRVRHHDPDRVENAIGRGVR
WNLGMQSKNGAWGAFDVDNTSPFPNRLPFCDFGEVIDPPSADVTAHVVEMLAVEGLSHDPRT
RRGIEWLLAEQEPDGSWFGRWGVNYIYGTGSVVPALTAAGLPASHPAIRRAVAWLEKVQNDD
GGWGEDLRSYKYVKEWSGRGASTASQTAWALMALLAAGERDSKAVERGVEWLASTQRADG
SWDEPYFTGTGFPWDFSINYHLYRQVFPLTALGRYVHGEPFSRTEAL

>seq_ID 231
MTATTDGSSGPVRAGAATAGDTTTTTAARTTAPGTDVREAAGRAAERAVEHLLARQDAQGW
WKGDLETNVTMDAEDLLLRQFLGIQDAATVEASARFIRGQQRDDGTWATFYGGPGELSTTIEA
YVALRLAGDRPDDPHMQRAASWVRSRGGIAAARVFTRIWLALFGWWKWDDLPELPPELILLPK
WVPLNIYDFGCWARQTIVPLTVVSAKRPVRPAPFALDELHTDPAMPNPQKRFAPAASWDGFF
QRADKALHLYHKVAPRRLRRAAMNAAARWIIERQENDGCWGGIQPPAVYSVIALHLLGYDLEH
PVMRAGLESLDRFAVHREEEGLPVRMIEACQSPVWDTCLATIALADAGLPADHPALVKAADWM
LSEQIVRPGDWAVRRPGLGPGGWAFEFHNDNYPDIDDTAEVILALRRVKHPDPERVEAAVARG
TRWNLGMQSLNGAWGAFDADNTSPFPNRLPFCDFGEVIDPPSADVTAHVVEMLAHEGMAED
PRTRRGVRWLLREQEANGAWFGRWGVNYVYGTGAVVPALIAAGLPASHPSVRRAVTWLESV
QNEDGGWGEDLRSYREEQSIGRGASTASQTGWALLALLSAGERDGRAVERGVAWLARTQRP
DGSWDEPYFTGTGFPWDFSINYHLYRQVFPLTALGRFLHGEKPVGRAAAREGG >seq_ID 227
MTATTDGSTGAANPSEATAHDPTDTTTAADDLTVAARRAAERSVEHLLGRQDEQGWWKGDL
ATNVTMDAEDLLLRQFLSIQDPETTRAAALFIRGEQLGDGTWNTFYGGPGDLSATIEAYVALRL
AGDRPDEPHMARAAGWIRDQGGIAAARVFTRIWLALFGWWKWDDLPELPPELMFFPKWVPL
NIYDFGCWARQTIVPLTIVSAKRPVRPAPFALDELHTDPDHPNPPRKLAPPTSWDGLFQRLDKG
LHLYHKVAPRPLRRVAMNLAARWIIERQENDGCWGGIQPPAVYSVIALHLLGYDLDHPVMKAG
LASLDRFAVRREDGARMIEACQSPVWDTCLATIALADAGLRPDHPALVKAADWMLAEEITRPG
DWSVRKPELAPGGWAFEFHNDNYPDIDDTAEVVLALRRVRHPDPARLQAAIDRGVRWNLGM
QSRNGAWGAFDADNTSPFPNRLPFCDFGEVIDPPSADVTGHVVEMLAVEGLASHPRTREGIE
WLLAEQEACGAWFGRWGVNYVYGTGSVVPALITAGLPAGHPAIRRAVAWLESVQNDDGGWG
EDLRSYQEEKWIGHGESTASQTAWALLALLAAGRRDTRPVARGVTWLTEAQQADGSWDEPY
FTGTGFPWDFSINYHLYRQVFPLTALGRYVHGDPFADRAMAAEGA >seq_ID 121
MQTQNRVTSTQKVELSNLTKAIIASQNYIMSRQYPEGYWWGELESNITLTAETILLHKIWKTDKT
RPFHKVETYLRRQQNEQGGWELFYGDGGELSTSVEAYMALRLLGVTPEDPALIRAKDFILSQG
GISKTRIFTKFHLALIGCYDWKGIPSIPPWIMLFPDNFPFTIYEMSSWARESTVPLLIVFDKKPIFEI
EPAFNLDELYAEGVENVKYALPRNHNWSDIFLGLDKLFKWTEKNNLVPFHKKSLQAAERWMLN
HQQESGDWGGIMPPMVNSLIAFKVLNYDVADPSVQRGFEAIDRFSIEEEDTYRVQACVSPVWD
TAWVIRALVDSGLKPDHPSLVKAGEWLLDKQILEYGDWAIKNKQGKPGGWAFEFINRFYPDLD

Enzyme Sequences

DSAVVVMALNGIKLPDENCKKAAINRCLEWMATMQCKPGGWAAFDVDNDQAWINEIPYGDLK

AMIDPNTADVTARVLEMVGSCGLKMDENRVQKALFYLEKEQESDGSWFGRWGVNYIYGTSGV

LSALAVIAPNTHKPQMEKAVNWLISCQNEDGGWGETCWSYNDPSLKGTGVSTASQTAWALIG

LLDAGEALETLATDAIKRGINYLLDTQTPDGTWEEAEFTGTGFPCHFYIRYHLRHYFPLIALGR

YWKIGLKNLKG

>seq_ID 120
MQTQNRVTSTQKVELSNLTQAIIASQNYILSRQYPEGYWWGELESNITLTAETVLLHKIWKTDKT

RPFHKVETYLRRQQNEQGGWELFYGDGGELSTSVEAYMALRLLGVTPEDPALIRAKDFILSKG

GISKTRFTKFHLALIGCYDWKGIPSIPPWIMLFPDNFPFTIYEMSSWARESTVPLLIVFDKKPIFEI

EPAFNLDELYAEGVENVKYALPRNHNWSDIFLGLDKLFKWTEKNNLVPFHKKSLQAAEKWMLN

HQQESGDWGGIMPPMVNSLIAFKVLNYDVADPSVQRGFEAIDRFSIEEEDTYRVQACVSPVWD

TAWVIRALVDSGLKPDHPSLVKAGEWLLDKQILEYGDWAIKNKQGKPGGWAFEFINRFYPDLD

DSAVVVMALNGIKLPDENRKKAAINRCLEWMATMQCKPGGWAAFDVDNDQAWINEIPYGDLK

AMIDPNTADVTARVLEMVGSCGLKMDENRVQKALFYLEKEQESDGSWFGRWGVNYIYGTSGV

LSALAVIAPNTHKPQMEKAVNWLISCQNEDGGWGETCWSYNDSSLKGTGISTASQTAWAIIGL

LDAGEALETLATDAIKRGIDYLLATQTPDGTWEEAEFTGTGFPCHFYIRYHLRHYFPLIALGRY

WKIGLKTPSVIPLN

>seq_ID 132
MFQGSDRPPVTLVMNDMRGPDMNVSDTVSVTRESIPTQTSAGDATARDLTAAVGSELTRALR

LATDHLLALQDGTGWWKFDLETNTSMDAEDLLLREYLGIRTTEVTAASARFIRSRQSDDGSWP

QYFGGPGELSTTVESYIALRLAGDDASAPHMLSAATWVRDHGGVPATRVFTRIWLALFGWWR

WEDLPALPPEIMLLPRRAPLNIYSFGSWARQTLVSLTVVSALRPVRPAPFDLDELYPDGPASAW

SGAGPSNVLERISTRFTAKEIFLGIDRLLHVYHRRPVRSMRNHALRAAERWIIARQEADGCFGGI

QPPAVYSIIALRLLGYELDHPVLKAALRALDDYSVTLPDGSRMVEASQSPVWDTALAVNALADA

GATAAIAPDHPALVRAAGWLLGQEVRHRRGDWAVNHPDVPASGWAFEFENDTYPDTDDTAE

VLLALRRVRHPARDELDAAERRAVAWLFGLQSSDGGWGAYDADNTSTIPYQIPFADFGALTDP

PSADVTAHVVELLAEAGLGGDDRTRRGVDWLLDHQEADGSWFGRWGVNYVYGTGSVMPAL

RAAGLEPSHPAMRAGADWLLTHQNADGGWGEDLRSYTDPEWSGRGESTASQTAWAMLALL

TVGDQPEVSGALARGARWLADHQRPDGSWDEDQFTGTGFPGDFYINYHGYRLLWPIMALGR

YLRG

>seq_ID 118
MLTYKEYRRSVTEIAMQTRDRQTQKPALSLNDAITASQNYLLSLQYPQGYWWAELESNITLTAE

TVLLHKIWGTDKTRPLHKVEAYLRQQQREQGGWELFYGDGGEISTSVEAYMALRLLGVPQDD

PALIRAKDFILSKGGISKTRIFTKFHLALIGCYSWKGIPSIPPWIMLFPNSFPFTIYEMASWAREST

VPLIIVFNDKPVFAVDPIFNLDELYAEGIENVKYELPKNNNWGDIFLGLDKVFKFAEQVDLVPFRK

KGLQAAERWMLNHQQETGDWGGIMPPMVNSLLAFRVLNYDVNDPSVQRGFEAIDRFSIEENE

TYRVQACVSPVWDTAWCVRALTNSGLPKDHFSLVKAGKWLLEKQCLEYGDWAVKNKTGKPG

GWAFEFTNRFYPDIDDSAVVVMALNGIKLPDEARKQAAINRCVKWIETMQCKEGGWAAFDVD

NDQAWLNEVPYGDLKAMIDPNTADVTARVVEMVGSCDLEISSKRLNKALNYLYKEQEKDGSW

FGRWGVNYIYGTSGVLSALAVINPEKHQPQIEQGINWLLSCQNKDGGWGETCWSYNDSNLKG

Enzyme Sequences

KGISTASQTAWALIGLLDAGEALNHFETDSIQRGISYLLNTQTEEGTWEESEFTGTGFPCHFYIR

YHFYRHYFPLIALGRYQNLSSEFGIRNSEL

>seq_ID 230
MTATTDGSSGPLRGGAATAGETTSTSAARTTEPGTDLREAAARAAERAVEHLLARQDAEGWW

KGDLETNVTMDAEDLLLRQFLGIQDPATVGASARFIRGQQRDDGTWATFYGGPGELSTTVEAY

VALRLAGDRPDDPHMQRAASWVRSRGGIAASRVFTRIWLALFGWWKWEDLPELPPELIFLPK

WFPLNIYDFGCWARQTIVPLTVVSAKRPVRPAPFALDELHTDPALPNPGKRLAPAASWDGFFQ

RADKALHAYHKVAPRRLRRAAMNAAARWIIERQENDGCWGGIQPPAVYSVIALHLLGYDLEHP

VMRAGLESLDRFAVHHEEEGLPVRMIEACQSPVWDTCLATIALADAGLPADHPALVKAADWML

SEQIVRPGDWSVRRPGLGPGGWAFEFHNDNYPDIDDTAEVVLALRRVKHPDPERVDAAVARG

TRWNLGMQSRDGAWGAFDADNTSPFPNRLPFCDFGEVIDPPSADVTAHVVEILAHEGMAHDP

RTRRGVRWLLAHQEANGAWFGRWGVNYVYGTGAVVPALTAAGLPGSHPAIRRAVAWLESVQ

NEDGGWGEDLRSYREEKSIGRGVSTASQTGWALLALLAAGERESKAVERGVAHLAQTQAPD

GSWDEPYFTGTGFPWDFSINYHLYRQVFPLTALGRYVHGEKLPGRAGAREGR

>seq_ID 234
MHEGEAMTATTDGSTGAATPPATTASAPLHLSPEARETHEATARATRRAVDFLLARQSDEGW

WKGDLATNVTMDAEDLLLRQFLGIRDEATTRAAALFIRGEQQEDGTWNTFYGGPGDLSATIEG

YVALRLAGDSPEAPHMRKASAFVRAQGGVARARVFTRIWLALFGWWKWEDLPEMPPELMFF

PKWAPLNIYDFGCWARQTIVPLTVVCAQRPVRPAPFALEELHTDPADPDPAQPAPPVVSWDNV

FHKLDKLLHGYRRIAPRRVREAAMRAAATWIVERQENDGCWGGIQPPAVYSIMALNLLGYDLD

HPVLRAGLASLDRFAVWREDGARMIEACQSPVWDTCLATVALADAGVPADHPQMIKAADWML

AEQIVRPGDWVVRRPDLPPGGWAFEFHNDNYPDIDDTAEVVLALRRVAHPDATRVDKAVRRA

VDWNVGMQSKNGAWGAFDADNTSPFPNRLPFSDFGEVIDPPSADVTAHVVEMLAEEGLAHH

PRTRRGIEWLLKNQEGNGSWFGRWGVNYVYGTGAVVPALVAAGLPASHPAIRRSVSWLGQV

QNEDGGWGEDLRSYQDSAWHGRGHSTASQTAWALLALLAAGERETEQVRRGIAYLVETQTE

DGTWDEPWFTGTGFPWDFTINYHLYRQVFPVTALGRYLNGTGPGEN

>seq_ID 123
MQTRDRQTHKPALSLNDAITASQNYLLSLQYPQGYWWAELESNITLTAETVLLHKIWGTDKTRP

LHKVEAYLRQQQREHGGWELFYGDGGEISTSVEAYMALRLLGVPSNDPALIRAKNFIISQGGIS

KTRIFTKFHLALIGCYSWKGIPSIPPWIMLFPNSFPFTIYEMASWARESTVPLIIVFNDKPVFAIDPI

FNLDELYAEGIENVKYELPKNNNWGDLFLGLDKVFKLAEQVDLVPFRKQGLQAAERWMLDHQ

QETGDWGGIMPPMVNSLLAFRVLNYDVADPSVQRGFEAIDRFSIEENDTYRVQACVSPVWDT

AWCIRALTDSGLPKDHFSLVKAGKWLLEKQVLEYGDWAVKNKTGKPGGWAFEFTNRFYPDID

DSATVVMALNGIKLPDEALKQAAINRCLKWIETMQCKAGGWAAFDVDNDQAWLNEIPYGDLKA

MIDPNTADVTARVVEMVGSCDLEMSSDRLNKALDYLYEEQEKDGSWFGRWGVNYIYGTSGVL

SALAVINPKQHKSQIEQGMNWLLSCQNEDGGWGETCWSYNDLSLKGKGVSTPSQTAWALIGL

LDAGEVLNHFETDSIERGINYLLNTQTEEGTWEESEFTGTGFPCHFYIRYHFYRHYFPLIALGRY

QQMLGS

>seq_ID 10
MTQASVREDAKAALDRAVDYLLSLQDEKGFWKGELETNVTIEAEDLLLREFLGIRTPDITAETAR

WIRAKQRSDGTWATFYDGPPDLSTSVEAYVALKLAGDDPAAPHMEKAAAYIRGAGGVERTRV

| Enzyme Sequences |
| --- |
| FTRLWLALFGLWPWDDLPTLPPEMIFLPSWFPLNIYDWGCWARQTVVPLTIVSALRPVRPIPLSI |
| DEIRTGAPPPPRDPAWTIRGFFQRLDDLLRGYRRVADHGPARLFRRLAMRRAAEWIIARQEAD |
| GSWGGIQPPWVYSLIALHLLGYPLDHPVLRRGLDGLNGFTIREETADGAVRRLEACQSPVWDT |
| ALAVTALRDAGLPADHPRVQAAARWLVGEEVRVAGDWAVRRPGLPPGGWAFEFANDNYPDT |
| DDTAEVVLALRRVRLEDADQQALEAAVRRATTWVIGMQSTDGGWGAFDADNTRELVLRLPFC |
| DFGAVIDPPSADVTAHIVEMLAALGMRDHPATVAGVRWLLAHQEPDGSWFGRWGANHIYGTG |
| AVVPALIAAGVSPDTPPIRRAIRWLEEHQNPDGGWGEDLRSYTDPALWVGRGVSTASQTAWA |
| LLALLAAGEEASPAVDRGVRWLVTTQQPDGGWDEPHYTGTGFPGDFYINYHLYRLVFPISALG |
| RYVNR |
| >seq_ID 233 |
| MRRRRSPRGPGAGPEADYGPARASAPDRLRGDAARGDAARRVQDATARAIRNLLGRQDPAG |
| WWKGDLETNVTMDAEDLLLRQFLGIRDEAVTQAAALFIRREQREDGTWATFHGGPPELSATIE |
| AYVALRLAGDAPDAPHMATASAWIRAHGGLAAARVFTRIWLALFGWWDWENLPELPPELVLLP |
| PWVPLNIYDFGCWARQTIVPLTVVSAMRPVRPAPFALDELHTDARVPVPPRRMAPPTTWNGA |
| FQWMDRALHVYRRFAPRRLREAAMASAGRWIIERQENDGCWGGIQPPAVYSVIALHLLGYDL |
| GHPVMRAGLESLDRFAVWREDGSRMIEACQSPVWDTCLAAIALADAGVRPDHPALVKAADW |
| MLGEEIVRTGDWAVRRPGLAPGGWAFEFHNDTYPDIDDTAEVVLALRRIRHPDPARVEAAIAR |
| GVSWNLGMQSRGGAWGAFDADNTSPFPNRLPFCDFGEVIDPPSADVTAHVVEMLAAEGRAA |
| DPRTRRGIAWLLAEQEPEGPWFGRWGTNYVYGTGSVVPALTAAGLSPGHPAIRRAVLWLESV |
| QNPDGGWGEDQRSYQDRAWAGKGESTPSQTAWALMALLSAGERDAKTVERGIAYLVETQLA |
| DGGWDEPHFTGTGFPWDFSINYHLYRHVFPLTALGRYLYGEPFGHDGRHIGAHLGDRTGVPA |
| EGV |
| >seq_ID 116 |
| MQTDDRLTQKQPLSLKDAITASQNYLLSLQYPQGYWWAELESNITLTAETVLLHKIWGTDKTRP |
| LHKVEAYLRQQQREHGGWELFYGDGGEISTSVEAYMALRLLGVPQDDPALIRAKDFIISKGGIS |
| KTRIFTKFHLALIGCYDWKGIPSIPPWIMLFPDSFPFTIYEMASWARESTVPLIIVFNDKPVFSVDP |
| VFNLDELYAEGVENVKYELPKNNNWGDIFLGIDQVFKFAEQVDLVPFRKEGLKAAEKWILNHQ |
| QETGDWGGIMPPMLNSLLAFRTLNYDVNDPSVKLGFEAIDRFSIEEDDTYRLQACVSPIWDTA |
| WCVRALTDSGLEKDHFSLVKAGKWLLDKQVMEYGDWAVKNKAGKPGGWAFEFTNRFYPDLD |
| DSATVVMALNGIKLPDEARKQAAINRCLQWIETMQCKEGGWAAFDLNNDQAWLNEVPYGDLK |
| AMIDPNTADVTARVVEMLGSCDLEIESDRLNKSLNYLYKEQEKDGSWFGRWGVNYIYGTSGVL |
| SALAVINPEKHKTQMEQGINWLLSCQNKDGGWGETCRSYNDPSLKGKGVSTPSQTAWSLIGL |
| LDAGEALNKFETDAIERGVNYLLDTQTEEGTWEESEFTGTGFPCHFYIRYHFYRHYFPLIALGR |
| YQNLSSEFGVRS |
| >seq_ID 124 |
| MQIRATVDTAKLEKAIAASQEHLLSTQYPEGYWWAELESNVTMTAEVVLLHKIWKTDGTRPMH |
| KAEKYLRSEQREHGGWELFYGDGGDLSTSVETYTALRLLGVPASDPALLKAKDFILRRGGISKT |
| RIFTKLHLALIGCYDWRGLPSLPPWVMLLPENFPFTIYELSSWARGSTVPLLIVMDRKPVFSVNP |
| QINVDELYAEGRDRVKFELPRKGDWTDLFIELDGLFKFTEQNNLVPFREEGLRAAERWVLERQ |
| EATGDWGGIIPAMLNSLLALRALGYHPADPYVRRGMAAVDRFAIETADTYRVQPCVSPVWDTA |

Enzyme Sequences

LVMRGLIDSGLPADHPAIVKAGEWLLEKQILAYGDWAVKNKTGQPGAWAFEFENRFYPDVDDS
AVVVMALQAAQLPDEDLKQQAIERCVKWIATMQCKPGGWAAFDVDNDQDWLNQIPYGDLKA
MIDPNTADVTARVLEMIGRSGVTTGEASVERALAYLRREQEVEGCWFGRWGVNYIYGTSGVL
AALALIAPKSDHAMIQRGADWLVRCQNADGGWGETCRSYNDPHLKGQGPSTASQTAWALIGL
LAAGEATGEFAWGAIDRGINYLLATQQQDGRWDEDWFTGTGFPGHFYLKYHLYQQHFPLTAL
GRYSSLTGLKQELKIPLQLKSKPEVVMIEDSDLLSDEDAT

>seq_ID 119
MQIQDRNSSPQVTEVLNQVKDAIAASQDYLMSIQYPEGYWWAELESNVTITAEVVLLHKIWGTD
KTRPLHKVETYLRRQQREHGGWELFYGDGGDLSTSVEAYMALRLLGVSIDDPALIRGREFILKR
GGISKSRIFTKLHLALIGCYDWRGIPSIPPWIMLLPENFPFTIYEMSSWARSSTVPLLIVFDKKPVY
CCDPTINLDELYSEGIENVKYDLPKTGDWTDIFVWLDGVFKFAQDYNLVPLRQESLQAAERWV
LERQEDSGDWGGIIPAMLNSLLALRALNYEAVDPIVHRGLQSVDNFAIETEDTYHVQPCISPVW
DTAWAIRALVESGLKADDPRLVKGAQWLLDKQILDYGDWAVKNKQGTPGGWAFEFDNRWYP
DLDDSAVVVMALDQVKMPNEDLKNGAIRRCVRWMATMQCKDGGWGAFDLDNDQNWLNFLP
YADLKAMIDPNTSDVTARVLEMLGTCGLIMDSNRVQKAIAYLEKEQEPDGSWFGRWGVNYIYG
TSGVLSALAVIAPETHQKELKKGAAWLVGCQNADGGWGETCFSYNDSSLKGKGDSTASQTA
WGLIGLLAAGEATGEFFKTAIERGVNYLLKTQREDGTWDENYFTGTGFPCHFYLKYHLYQYFP
LIALSRYQRLLT >seq_ID 9
MSVSERAQPGGNPIPGSTSQSAVKFGRIDAALEDVKRAIAGAKDRVFAQQSKDGWWCGELEA
DSMLEADYIFAHTLLGTGDAGKMKRALTEMLRYQNEDGSWSIYPGGPGNISLTVKCYFSAKLM
GMTADNPILVKAREWILAHGGVVECNTFTKIYLCFLGQYEYDAVPAIPPEIVLFPNWFYFNIYEIS
SWSRAILVPLSIAYAKKPFKKIPPEQGIDELFVGGREKANLHLRWDSKNLLSWRNFFLALDRVTH
WFERVHIRPLRSIALKKAEKWMLARFEMSDGLGAIYPAMLNAIIALRCLGYSLDDPQVLRAMDE
FEKLGIDEPEGTAEYAEPTFRMQPCVSPVWDTAQAVFALGEAGVPRNDPRMQKAADWLLSKE
VRHKGDWAMKVRNAQPGGWYFEFNNEFYPDVDDSAQVLLALNKVDNPRERYQYDVCQRAID
WIFAMQCRNGGWASFDKDNTKMIFQYVPFADHNAMLDPPTVDITGRILEMLATYGYTRKDRRV
EKAIKFIYDEQEPDGSWFGRWGVNYLYGTFLVLRGLEAIGVWNHEPQIQQAAEWIRSVQNADG
GWGETCGSYDDPNTRGVGPSTPSQTAWAILGLLSAGDDRSDSVAKGIKWLLAHQKPDGGWD
ESTGSGSKHQALYTGTGFPRVFYLAYHQYRDYFPLLALTNYEKAMERGE >seq_ID 217
MTEEVLQRTAAPAEVLAAAREHLLSLQHERGWWKGELETNVTMDVEDLLLRRFLGILTTAETE
QAARWIRSRQRADGTWAQFHGGPGDLSTTVEAYVGLKLAGDDVDSEHMAAARAWILERGGIE
ETRVFTRIWLALFGEWSWDDLPAMPPELVLLPPWVPLNLADWGCWARQTIVPLTVVCTLRPR
RDLGVGLAELRSGRRRRKVPSPSWAGAFQVLDGALHGYQRHPLRGLREHAMRRAAEWIVAR
QEADGSWGGIQPPWVYSLLALHLLGYPLDHPVLRQGLAGLERFLIREETPEGTVRRLEACQSP
VWDTVLSMQALRDAGLAADHPALRRAADFVLAEEIRVKGDWSVRRPDLAPGGWAFEFDNDG
YPDIDDTAEVVLALNRVDHERPGAVNAAIDRGVRWMSGMQSADGGWGAFDADNTRELVNEL
PFCDFGAVIDPPSADVTAHVVEALCVLGRGDGEAVRRGVRWLLDHQELDGSWFGRWGANHV
YGTGAAVPALVRAGLRRDHLALRRAVRWLEVHQNDDGGWGEDLRSYDDPVWVGRGRSTAS

Enzyme Sequences

QTAWALLALLAVDLHDTDAVRRGVGFLAETQRPDGTWDEPQFTGTGFPGDFYINYHLYRLVFP

VTALGRYEQARREQSGGSG

>seq_ID 249
MIEKNKVKQSILASQKHLLSLQETEGYWWGQLESNVTITAEIILLHKIWQTDKKIPLNKAKNYLIS

QQREHGGWELFYGDGGDLSTSIEAYMALRLLGVSRTDPIMIEAQNFIIKKGGISCSRIFTKLHLAL

IGCYSWQGIPSIPSSIMLLPEDFPFTIYEMSSWARSSTVPLLIVFDKKPIFSVNPTINLDELYAEGI

NNASFELPRKYDLTDLFLGLDKAFKFAENLNLMPLQQEGLKAAEKWILERQEVTGDWGGIIPAM

LNSMLALKCLEYDVADPVVVRGLEAIDRFAIENEDSYRVQACVSPVWDTAWVIRSLVDSGISPS

HPAMVKAGQWLLQQQILDYGDWVFKNKFGKPGGWAFEFMNRFYPDIDDTAVVVMALDVVEL

PDEDLKGKAIARGMEWIASMQCEAGGWAAFDVDNNQDWLNATPYGDLKAMIDPNTADVTGR

VLEMVGCCGLAMDSWRVKRGIDFLVREQEEEGCWFGRWGVNYIYGTSGVILALAVMARESHR

GYIERGASWLVGCQNSDGGWGESCWSYNDPSLKGKGKSTASQTAWALIGLLAAGEGTGNFA

RDAIDGGVGFLVSTQNDDGSWLEDEFTGTGFPGHFYIKYHFYSQYFPLMALGRYESLLSG

>seq_ID 222
MAVRDRVNPKTLEAAIAASQSYLLTQQDETGYWWAELESNVSITSEVVLLHKIWGTDRSRPLE

KVETYLRSQQRDHGGWELYFDDGGEISVSVEAYMALKLLGVPMEDPAMVRARQFILEHGGISR

TRVFTKLHLALIGCYEWRGIPSLPPWVMLLPEQFPFTIYEMSSWARGSTVPLLIVMDREPVYAV

EAGFNLDELYVEGRHRAQFDLPLSNEWTDAFIYLDGLFKFAESTNLVPFREEGIRAAERWILER

QEATGDWGGIIPAMLNSLLGLKALDYDVHDPIIERGMAALDAFALETEDQYWIQPCISPVWDTA

LVVRGLAESGLAPDHPALVKAGEWLLNKQILDYGDWSVKNPGGLPGGWAFEFDNRFYPDVDD

TAVVVMALNEVQLPDEQAKDAAIARAVNWIATMQCRPGGWAAFDINNDQDWLNALPYGDLKA

MIDPNTADVTARVLEMIGRCHQTTGKNSVDRALRYLRTEQEPEGCWFGRWGVNYIYGTSGVL

AALALIDPQGWQSQIQQAAAWLVSCQNTDGGWGETCASYDNPKLKGQGPSTASQTAWAIMG

LLSAGEATSVYAEAAIERGVNYLTTTQKMDGTWDEDYFTGTGFPGHFYLKYHLYQQHFPLTAL

GRYQAMLQQKS

>seq_ID 186
MRTQDRVQVNSIAEAIAASQKYLLSLQNPAGYWWAELESNVTITAEVVLLHKIWGTDKTRPLHK

VEAYLRSQQKQHGGWELFYGDGGELSTSVEAYMALKLLGVPATDPAMIQARDFILQRGGISKT

RIFTKFHLALIGCYNWRGLPSLPAWVMLLPNQFPVNIYEMSSWARSSTVPLLIVFDQKPVYQVN

PTITLDELYAEGVENVRYELPRSGDWTDLFLTLDEGFKLAESFNFIPFREEGIKAAEKWIIERQEA

TGDWGGIIPAMLNSMLALRSLGYDTNDPIVERGLQALDNFAIETVDCYRVQPCVSPVWDTAWVI

RALIDSGIAPDHPAIVKAGEWLLQKQILDYGDWNVKNRQGKPGAWAFEFENRFYPDVDDTAVV

VMALHAAKLPNEQLKQKACDRALQWVASMQCKPGGWAAFDLDNDQDWLNSVPYGDLKAMID

PNTADVTARVIEMLGACNLSIDSHNLERALTYLLNEQEAEGCWFGRWGVNYIYGTSGVLSALAL

INPQKYQRHIQQGATWLVGCQNPDGGWGETCFSYNDPSLKGQGDSTPSQTAWALIGLIAAGE

ATGNFAHDAIERGINHLVSTQQPDGSWFEAYFTGTGFPCHFYLKYHYYQQYFPLIALGRYQAIK

SL

>seq_ID 153
MQVQPRIEKKHLDSAIEASQAYLLARQYSPGYWWAELESNVSMTAEVVLLHKIWRTDTGRPLA

KATAHLLAEQRAHGGWELFYGDGGDLNTSIEAYMALKLLGLTADHPALARARAFILAKGGISRA

RIFTKIHLALIGCYDWRGVPSIPPWVMLLPEAFPVNIYEMSSWARGSTVPLLIVFDRKPVFAVEP

Enzyme Sequences

AITLDELFVEGRAQARFDLPRSSSDWWANLFVDLDWGFKLAESLGAVPLREEGLKAAERWVLE
RQEATGDWGGIIPAMLNSLLALRCLDYDPHDPVVERGMAAVDRFAIETESTYRLQPCVSPVWD
TALTMRALVDSGLPPDHPALAAAGTWLLKKQILDYGDWAVKNRTGPPGGWAFEFDNRFYPDV
DDTAVVVMALDAVRLADETAKGQAIARAVCWVASMQCRGGGWAAFDIDNDAHWLNSLPYAD
LKAMIDPNTADVTARVLEMYGRCRLIPAAAGAQRALDYLRRTQEPEGCWFGRWGVNYLYGTS
GVLSALAAFAPAERTAIERAAAWLRGCQNTDGGWGETCGSYVDRTLMGQGPSTASQTAWAL
LGLIDASRVARFSDSSALERGLAYLVETQKADGSWDEPYFTGTGFPGHFYLKYHLYQQHFPLS
ALGRYRRLLS

>seq_ID 122
MQIQARNISTKVTEVFSKVKEAIAASQQYLLSIQYPEGYWWAELESNVTITAEAVLLHKIWGTDT
TRPLHKVETYLRRQQREHGGWELFYGDGGDLSTSVEAYMALRLLGVSASDPALVRAKAFILSR
GGISKSRIFTKMHLALIGCYDWRGVPSIPPWIMLLPENFPFTIYEMSSWARGSTVPLLIVFDKKP
VYQCGITLDELYSEGINHVRYDLPRNGDWTDVFVWLDGVFKFAETNNLIPFRNESLKAAERWV
LERQEDTGDWGGIIPAMLNSLLALRALDYEVNDPIVHRGFKSVDNFAIETEETYHVQPCISPVW
DTAWVLRALVESGLKPDEPVLVKGAQWLLDKQILDYGDWAVKNKEGTPGGWAFEFDNRWYP
DLDDSAVVVMALEQVKMPDEQLKYGAMRRCVRWMATMQCKAGGWGAFDVNNDQNWLNYL
PYADLKAMIDPNTADVTARVLEMLGTCELSMDHDRVKRAIAYLEQEQEADGSWFGRWGVNYI
YGTSGALSALAAIAPVTHQAQIEKGAAWLVGCQNPDGGWGETCFSYNNPALRGKGDSTASQT
AWGLIGLLAAGEATGKFAKTALERGVNYLLATQRPDGTWDESYFTGTGFPCHFYLKYHLYLQY
FPLIALSRYQRLLGFN >seq_ID 129
MSLTSDPSPAAPTAEKSPKRPTIPVPATADAYGISRSSPPLPAATGRPQAAGPASAGVATARAR
DHLLALQSEEGWWKGDLETNVTMDAEDLFMKQFLGIRGDDETEQTARWIRSQQLADGGWPT
FYGGPADLSTTIEAYIALRLAGDAVDAPHMARAAELVRAQGGVAASRVFTRIWLAALGQWSWD
DVPVIPPELIFLPSWIPLNVYDFACWARQTIVALTIVGSLRPSHDLGFSIDELKVPAAARKPAALR
SWEGAFERLDKLLHRYEKRPIKLLRTLALRRATEWVVARQEADGCWGGIQPPWVYSVMALHL
MGYPLNHPVIATAFRGMERYVIRRDTPQGPIRQIEACQSPVWDTALAVVALADAGVPGDHPAM
VKAGRWLVDEEVRVAGDWAVRRPELAPGGWAFEFDNDFYPDVDDTAEVVLALRRLLGAGHV
APPASRQGRAEAPPVNTVEDADPRLAAAMRAAAARGVDWSVGMRSSNGAWGAFDADNVRT
LTTKIPFCDFGEVVDPPSADVTAHIVEMLADLGRSDHPITQRAVQWLLDNQEPGGSWFGRWG
VNHLYGTGAVVPALIGAGVPTDHPAITAAVRWLLEHQSPEGGWGEDLRSYTDPAWIGRGELTA
SQTAWALLALLAVDPHSLAVKRGVRWLCETQRPDGTWDEPYFTGTGFPGDFSLNYHLYRLVF
PLTALGRYVSLTGVATP >seq_ID 164
MHSGRVFLEKENREENRATFHSSPLILVEESLNLPKKVEETIKKAQRYLLSIQKEDGHWVGELF
VDVTLACDCIHLMHWRGKIDYKKQLRLVKHIVDRQLPDGGWNIYPGGPSEVNATVKAYFALKLA
GFSPDDPLMAKARSTILRLGGIPKCMTYTKLGLALLGVYPWDRLPVIPPEIILFPNWFPFNIYEISA
WSRAMLVPLSVIHHFKPTRNLPEKYQLHELFPYGTEHGKFSWLKKGARYLSKQGLFLACDKFL
QYWDKTSLKPFRKMALKKAEKWLLERISAGSDGLGAIFPAMHYAIMALIAMGYTEDNPILKKAIA
DFEGLEVDDKKNDDLRIQPCLSPVWDTAVGLVALAESGVARNAKELKRAAYWLLDREIKIKGD

Enzyme Sequences

WHVRNPHPEPSGWAFEYNNVYYPDVDDTLMVLLALRLIDIEDKIRKEEVMQRALRWVISFQCK

NGGWAAFDKDVYKKWLEDIPFADHNAILDPPCSDITARALELFGKMGIKKTERFVQKAIAYLKET

QENDGSWMGRWGVNYIYGTWQALRGLQAIGENMNQEWILRARDWLESCQNEDGGWGETP

ASYDNPQLKGKGPSTASQTAWAVSGIMACGDIFRPSVSRGIKYLCDRQLSDGSWAEEFLTGT

GFPGVFYLKYDMYRNAWPLLVIGEYHRQYLKAKEQVSYWVDGTIGRKVKKERLPEI

>seq_ID 20
MRTQDRVQVNSIAEAIAASQKYLLSLQNPTGYWWAELESNVTITAEVVLLHKIWGTDKTRPLHKI

EAYLRSQQKQHGGWELFYGDGGELSTSVEAYMALKLLGVPATDPAMIQARDFILQRGGISKTR

IFTKFHLALIGCYNWRGLPSLPAWVMLLPNQFPVNIYEMSSWARSSTVPLLIVFDQKPVYQVNP

AITLDELYAEGVENVRYELPRSGDWTDLFLTLDEGFKLAESFNFIPFREEGIKAAEKWIIERQEAT

GDWGGIIPAMLNSMLALRVLGYATNDPIVERGLQAIDNFAIETADCYRVQPCVSPVWDTAWVIR

ALIDSGMAPDHPAIVKAGEWLLQKQIFDYGDWNVKNRQGQPGAWAFEFDNRFYPDVDDTAVV

VMALHAAKLPHEQLKQKACDRALQWVASMQCKPGGWAAFDIDNDQDWLNAVPYGDLKAMID

PNTADVTARVIEMLGACNLSIDSHDLERALTYLLNEQEAEGCWFGRWGVNYIYGTSGVLCALAL

INPQKYQRHIQQGATWLVGCQNPDGGWGETCFSYNDPSLKGQGDSTPSQTAWALIGLIAAGE

ATGNFAHDVIERGINHLVSTQQPDGSWFEAYFTGTGFPCHFYLKYHYYQQYFPLIALGRYQAIN

PL

>seq_ID 185
MQTQDRVKVNQVAEAIAASQQYLLSIQNPAGYWWAELESNVTITAETVLLHKIWGTDQTRPLH

KVEAYLRQEQRQHGGWELFYGDGGELSTSVEAYMALRLLGVPATDPAMIRAQAFILQRGGISK

TRIFTKLHLALIGCYNWRGIPSLPPWIMLLPKAFPVNIYEMSSWARSSTVPLLVVCDRKPVFITDP

TINLDELYAEGIDRVRWELPQSGDWTDLFLTLDQGFKWAESLNLVPFREEGIKAAEKWILERQE

ATGDWGGIIPAMLNSMLALRCLDYDRSDPIVERGLQAIDNFAIETDNSYRVQPCVSPVWDTAW

VMRALVESGFVPDHPAVVKAGEWLLQKQILDYGDWAVKNRQGKPGAWAFEFENRFYPDVDD

SAVVVMALHLAKLPNEKIKQAAIARAVNVWIASMQCKPGGWAAFDLDNDQDWLNSIPYGDLKAM

IDPNTADVTARVVEMLGACDLSIDSDNLERSLTYLLREQETEGCWFGRWGVNYIYGTSGVLSA

LALIDPQRHKLSIERGAAWLLGCQNLDGGWGETCRSYDDPSLKGKGDSTASQTAWALIGLLAA

GEATGKLAVKAIEQGIGYLMATQQPDGTWFEANFTGTGFPCYFYLKYHLYQQYFPLIALGRYQ

AAIKES

>seq_ID 244
MVIAASPSVPCPSTEQVRQAIAASRDFLLSEQYADGYWWSELESNVTITAEVVILHKIWGTAAQ

RPLEKAKNYLLQQQRDHGGWELYYGDGGELSTSVEAYTALRILGVPATDPALVKAKNFIVGRG

GISKSRIFTKMHLALIGCYDWRGTPSIPPWVMLLPNNFFFNIYEMSSWARSSTVPLMIVCDQKP

VYDIAQGLRVDELYAEGMENVQYKLPESGTIWDIFIGLDSLFKLQEQAKVVPFREQGLALAEKWI

LERQEVSGDWGGIIPAMLNSLLALKVLGYDVNDLYVQRGLAAIDNFAVETEDSYAIQACVSPVW

DTAWVVRALAEADLGKDHPALVKAGQWLLDKQILTYGDWQIKNPHGEPGAWAFEFDNNFYPD

IDDTCVVMMALQGITLPDEERKQGAINKALQWIATMQCKTGGWAAFDIDNDQDWLNQLPYGDL

KAMIDPSTADITARVVEMLGACGLTMDSPRVERGLTYLLQEQEQDGSWFGRWGVNYLYGTSG

ALSALAIYDAQRFAPQIKTAIAWLLSCQNADGGWGETCESYKNKQLKGQGNSTASQTAWALIG

Enzyme Sequences

LLDALKYLPSLGQDAKLTTAIEGGVAFLVQGQTPKGTWEEAEYTGTGFPCHFYIRYHYYRQYFP

LIALARYSHLQAS

>seq_ID 109
MDDRHIQSEITFGKIDGIRERIQQAMDAAKRYLFSKQDPEGFWCGELEADTTLQSDYIVMHTLL

GTGDPVKMQKAGKQILQHQNPDGGWNIYPDGPSNISAAVKAYFSLKLIGHKPDEPEMTKARE

WILAHGGVTACNTFSKMYLCFFGQYDYDTVPAIPPEIVLFPNWFWFNLYEISSWSRGILVPLAIC

YAKKPFKKIPDEANIDELFVEGRHANLHLTWDKKPFSWRNFFLVLNNMVHFFERVHVRPLRKLA

MKRAEKWMLERLEMSDGLGGIYPAILNSIIALRALGYSTDDPQVIRAMDEFEKLGIEEDDTFRM

QPCMSPVWDTAYALYALGEAGVPGSDPRMQKAAEWMLKKQVTHKGDWAVKVRNVQPGGW

YFEENNEFYPDVDDTAQVILSLNHVRTSNERYQDDTVKRALDWQLAMQCKNGGWASFDKDN

NKMVFQYIPFADHNAMLDPATVDITGRVLEALSHHGYSLKDKVVQRAVKFIQSEQEPDGSWFG

RWGVNYIYGTMLCLRGLAAVGVDHHEPMVQQAAEWLRMVQNPDGGWGESVGSYDDPKLRG

QGPSTASQTAWAVMGLLAANDLRSDSVTRGIAWLLENQKPNGSWWEKWITGTGFPRVFYLKY

TMYAEYFPLIAFAEYLRRLNTPLDEKVKLGPQA

>seq_ID 174
MQIQDKITEIAAKTAKAIELSQNYLLSTQYSEGYWWAELESNVTITSEAILLHKIWKTDKKRPLDK

AATYLRQQQCPNGAWELFYGDGGDLSTTVEAYMGLRLLGIPANDPALEKAREFILAKGGISKTR

IFTKMHLALIGCYDWQGVPSIPAWIMLLPENFPFTIYEMSSWARGSTVPLLIVFDKKPVYKMGFN

LDELYTEGVNNVKYELPKNNNWSDVFLWLDGLFKWAEKTDLVPFRQESLKAAEKWVIERQED

TGDWGGIIPAMLNSLLALKALDYDVYDPIVARGLKAVDNFAIETDNTYCVQPCVSPVWDTAWVI

RSLIESGLNPAHPAMIKAGQWLIDQQILDYGDWAIKNKIGTPGGWAFEFDNRWYPDLDDSAVV

VMALELIKMPDENIKTSVMKRAVNWMATMQCKAGGWGAFDIDNDQNWLNSLPYADLKAMIDP

NTADVTARVLEMLGTCDVKMGENRVKKALDYLEKEQEADGSWFGRWGVNYIYGTSGALSALA

FLEPNQYRQQLQKGANWLSSCQNVDGGWGETCFSYNNPKFKGQGNSTASQTAWALIGLLAV

GKVTGNYQREVIEKGVNYLLVTQKENGTWDEDYFTGTGFPCHFYLKYHFYQQYFPLLALGRYR

ALI

>seq_ID 130
MSLTSDPSPAAPKAAKSSKRVNIPAPATPDAYGISRSSPPLSGGGVSGGGVSGGGAATADGTP

PTTQTSVDPDLAAAMTAANQARDHLLGLQSEEGWWKGDLETNVTIDAEHLFMKQFLGIRTEEE

TEPIARWVRSQQLADGGWATYYGGPAELSTTVEAYIALRLAGDEPDAPHMAAAAALIRSQGGV

AAARVFTRIWLATFGEWSWDDVPVLPPELIFLPSWFPLNVYDFGCWARQTIVALTIVGSLRPVR

DLGFSIDEIKVAAPVTPPKPAPLHSWEGAFERLDAILHRYERRPIKVLRTLALRRATEWVVARQE

ADGCWGGIQPPWIYSVMALHLMGYPLNHPVIATAFRGMERYIIRRETPEGPTAQIEACQSPVW

DTALAVVALSDAGVPADHPAMVRAGRWLVDEEVRVAGDWAVRRPALAPGGWAFEFDNDFYP

DTDDTAEVVLALRRLLGGSHVTPGGTVTPSGSVTPGGTAELSPAARDRASRGLAAVDPQLAG

AMRAAAARGVDWSVGMRSSDGAWGAFDADNVRTLTAKIPFCDFGEVVDPPSADVTAHIVEML

ADLGRSDHPITRRAVQWLLDNQEPGGSWFGRWGINHVYGTGAVVPALIAAGVPADHPAITAAV

RWLLEHQSPDGGWGEDPRSYDDPAWIGRGELTASQTAWALLALLAVDPHSKAVKRGVRWLC

ETQRPDGTWDEPQFTGTGFPGDFYLNYHLYRLVFPLTALGRYVTLTGVATP

Enzyme Sequences

>seq_ID 248
MPTSLATAIDPKQLQQAIRASQDFLFSQQYAEGYWWAELESNVTMTAEVILLHKIWGTEQRLPL

AKAEQYLRNHQRDHGGWELFYGDGGDLSTSVEAYMGLRLLGVPETDPALVKARQFILARGGI

SKTRIFTKLHLALIGCYDWRGIPSLPPWIMLLPEGSPFTIYEMSSWARSSTVPLLIVMDRKPVYG

MDPPITLDELYSEGRANVVWELPRQGDWRDVFIGLDRVFKLFETLNIHPLREQGLKAAEEWVL

ERQEASGDWGGIIPAMLNSLLALRALDYAVDDPIVQRGMAAVDRFAIETETEYRVQPCVSPVW

DTALVMRAMVDSGVAPDHPALVKAGEWLLSKQILDYGDWHIKNKKGRPGGWAFEFENRFYPD

VDDTAVVVMALHAVTLPNENLKRRAIERAVAWIASMQCRPGGWAAFDVDNDQDWLNGIPYGD

LKAMIDPNTADVTARVLEMVGRCQLAFDRVALDRALAYLRNEQEPEGCWFGRWGVNYLYGTS

GVLTALSLVAPRYDRWRIRRAAEWLMQCQNADGGWGETCWSYHDPSLKGKGDSTASQTAW

AIIGLLAAGDATGDYATEAIERGIAYLLETQRPDGTWHEDYFTGTGFPCHFYLKYHYYQQHFPLT

ALGRYARWRNLLAT

>seq_ID 150
MAKGILNKFAVIAGTKKAGPPAGEERTVIAPIKEISGKAVHCSQAVKKAEEYLLALQNPEGYWVF

ELEADVTIPSEYIMLQRFLGREISPELGKRLENYLLDRQLPDGGWPLYAEDGFANISATVKAYLA

LKVLGHSPQAPHMIRARLMVLSLGGAARCNVFTRILLALFGQIPWHTPPAMPVEIVLLPQWFFF

HLSKVSYWSRTVIVPLLLLYAKQPVCRLRPEEGIPELFSTPPDKLRHLDGFQPGYWRKNAFIIFD

RLLKRFNRFIPSALHRKAIAEAEQWTRSHMQGSGGIGAIFPAMAYAVMALRVLGCGEGDPDYIR

GLQAIDDLLQHRTPQEADPPRTDGTCIDSGMSAAFALTPSAHAAADGTGSSSICQPCNSPIWD

TCLSLSALMEAGMPASHPAATQAVEWLLSQQILSPGDWSLKVPDLEGGGWAFQFENTLYPDL

DDTSKVIMSLLRAGALENERYRDRIARGVNWVLGMQSSGGWAAFDIDNNYHYLNDIPFADHG

ALLDPSTSDLTGRCIELLSMVGFDRTFPPIARGIGFLRSEQEENGAWFGRWGVNYIYGTWSVLS

GLRQGEDMQQPYIRKAVGWLASCQNHDGGWGETCYSYDDPSLAGKGASTPSQTAWSLLG

LMAAGEVNSLAVRRGVRYLLDHQNQWGTWEEKHFTGTGFPRVFYLRYHGYRHFFPLWALGV

YSRLSSGQKACQDERRHASPGDLHLPWLERIKKR

>seq_ID 128
MPDLELRDVDRADGRHHAPNLGRTDTLSPSAPTGEPAPASTPAAVATPTPTPTTAPAPAPAPE

NALRETVQRAAEHLLRLQDPRGWWKFDLETNPTMDAEDLLLREYLGIRTVEQTEATAKHIRSR

RLDDGSWPTYFGGPGELSTTVECYIALRLAGDSPDDEPLRRSAAWIRERGGIPATRVFTRIWLA

LFGWWRWEDLPVLPPEIMFLPPRAPLSIYSFASWARQTIVPLTIVSAARPQCPAPFDLAELDPD

EVPAAQSHGAAQSPDTRSPAGGRTLRGAMRRLGGDRPNTAKVFFRGLDAALHRYHRHPIGPL

RRHALRTAERWIIARQEADGCFGGIQPPAVYSIIALRLLGYDLDHPVLAAALRSLDAYTLHREDG

SRMIEASQSPIWDTALAVLALADAGIDAPADVDVAPALPTQRVATGAPAPSAPVPTALERAADW

LLGQEIQHRRGDWAITHPGVAPGGWAFEFDNDTYPDTDDTAEVVLALHRLNRLRRLRHPTNTR

IDAALERSTAWLFALQSRDGGWGAYDSDNASTLVYQIPFADFGALTDPSSADVTAHVVELLCE

TGRIRDPRTLRGVDWLLRNQEADGSWYGRWGVNYVYGTGSVLPALQAAGLPPTHPAMVAGA

RWLLSRQNSDGGWGEDIRSYGDPAWSGRGLSTPSQTAWAMLGLLATDHGGVHADALAAAA

RWLTEQQRPDGGWDEEMFTGTGFPGFFYLNYHGYRLVWPVMALGRYLHSRQHPSD

>seq_ID 131
MSLTSDQSSAAPTAAAQSPKIPNPSVARPSADAGSFETAGAVRTDSVSIDSVSTGTPVDPVVG

AMRRGRDHLLSLQAEEGWWKGELETNVTMDAEDLMLRQFLGILTPSTATETGRWIRSQQLSD

Enzyme Sequences

GGWATFYGGPSDLSTTIEAYVALRLAGDDPDAPHMRSAAEWVRSAGGIAASRVFTRIWLALFG

EWSWDDVPVLPAEMTFLPPWFPLNIYDFACWARQTVVALTIVGSLRPVRSFGFTLDELRVQAP

KATKAPLRSWAGAFERLDSVLHRYEKRPFQPLRRLALRRAAEWVIARQEADGCWGGIQPPMV

YSIMALHLMGYPLNHPVISMAFRALDRFTIREETPEGTVRRIEACQSPVWDTALAVVALADAGL

GGDHPAMVRAGRWLADEEVRVAGDWAVRRPTLAPGGWAFEFDNDFYPDVDDTAEVVIAIRR

LLGDGHGPVDHSDGSGPGSAAATAASAAAEAAVAAAGTIAAADPELAARLRAAAERGVDWSV

GMRSSNGAWAAFDADNVRTLVRKIPFCDFGEVVDPPSADVTAHMVEMLALLGRSDHPITQRG

VRWLLDNQEAGGSWFGRWGVNHVYGTGAVVPALISAGVDAEHPAIVSSMHWLVEHQTPEGG

WGEDLRSYRDDEWIGRGEPTASQTAWALLALLAAEPASGTAEWEAVERGVRWLCDTQRPDG

TWDEPQFTGTGFPWDFSINYHLYRLVFPVTALGRYVTLTGRSTS

>seq_ID 242
MSISALQTDRLSQTLTQSVVAAQQHLLSIQNPEGYWWANLESNASITAEVVLLHKIWGTLDSQP

LAKLENYLRAQQKTHGGWELYWNDGGELSTSVEAYMGLRLLGVPASDPALVKAKQFILHRGG

VSKTRIFTKFHLALIGCYRWQGLPSLPAWVMQLESPFPFSIYELSSWARGSTVPLLIVFDKKPVY

PLQPSPTLDELFTESAENVRWELEEKGDWSDAFLWLDKAFKLAESVDLVPFREESIRKAEKWV

LERQEPSGDWGGIIPAMLNSMLALRALGYSVSDPVVRRGFQAIDNFMVESETECWAQPCISPV

WDTGLAVRSLTDSGLSPNHPALVKAGEWLLDKQILSYGDWSVKNPQGQPGGWAFEFENSFY

PDVDDTAVVAMALQDITLPNEPLKRRAIARAVRWIATMQCKTGGWAAFDINNDQDWLNDIPYG

DLRAMIDPSTADITGRVLEMHGRFAADLDLANSYAADLSPYRLSRGLNYLIKEQELDGSWFGR

WGVNYIYGTGQALSALALIAPERCRIQIERGIAWFVSVQNADGGWGETCESYKDKSLKGKGIST

ASQTAWALLGLLDVSFCLDPAAKIAVDRGIQYLVSTQSEGTWQEESFTGTGFPQHFYLRYRLY

CHYFPLMALGRYQRVINSSAGI

>seq_ID 143
MAKGILNKFAVIAGNKNAGLTAEEECTVVAPIKEVSGKAVHCRQAVKMAEEYLLALQNPEGYW

VFELEADVTIPSEYIMLQRFLGREISPELRMRLENYLLDRQLPDGGWPLYAVDGFANISATVKAY

LALKVLGHSPQAPHMIRARIMVLSLGGAARCNVFTRILLALFGQLPWHTPPAMPVEIVLLPQRFF

FHLSKVSYWSRTVIVPMLLLYAKQPVCRLRPEEGIPELFNTPPDKLRNLDGFQSGRWRKNAFIII

DRLLKRFNRFIPSAIHRKAMAEAEHWTRSRMQGSGGIGAIFPAMAYAVMALRVLGCREDDPDY

VRGMQAIDDLLQHRTPQEADSPRTGGPCIDSGTSAAFAFDPSPHAAADGRGNSSICQPCNSPI

WDTCLSLSALMEAGMPASHPAAKQAVEWLLSQQIFSPGDWSLKAPDLEGGGWAFQFENTLY

PDLDDTSKVIMSLLRAGALENGLYRDRVARGVNWVLGMQSSDGGWAAFDIDNNYHYLNDIPF

ADHGALLDPSTSDLTGRCIELLSMVGFDRTFPPIAQGIGFLRSKQEGSGAWFGRWGVNYIYGT

WSVLSGLRQAGEDMQQPYIRRAVGWLTSCQNHDGGWGETCYSDDPSLAGQGESTPSQTA

WSLLGLMAAGDVHSLAVRRGVRYLLDHQNQWGTWEEKHFTGTGFPRVFYLRYHGYRHYFPL

WALGVYSRLSSGQKTRQEERRHSSPGDLHLPWLERIGRR

>seq_ID 71
MIKNFTALWPIRRVKGVSVTSQDGHSANGASKPDFEVRPHVDLETAIHRSQSFLLKEQKPEGY

WVGELIVDSTLVSDTIAYHHWNGKVDMEWQRKAVNHIFSMQLPDGGWNIYYGGPAEINATVKA

YLALKLAGVPVMDPRMLRARSVALSMGGVPRMNTFSKLYLALLGLFPWNYVPTIPCEVILIGKW

FHVNFYEMSSWSRSMLVPLAIINHFKPTRKLQNQVKLDELYPEGYHERDLALPPDPEFLTFRNF

Enzyme Sequences

FLWLDKLHKFAELWVQAGIHPFRRRALKKCEHWMLERFEGSNGLAAIFPAMLNSLIALKALGYP
GDHPEVKRAEKELKNLEHETADTVRIEPCFSPVWDTAIVAICLHESGIPSDHPALKKSAEWLIDK
EIRFRGDWYFKNPVDVEPSGWVFEFENKWNPDVDDTAMVLLALRKIPTSDVKRRDECFQRGL
KWMMAFQCKDGGWAAFDKDCTKGILEKVPFADHNAMLDPECADITARILELLGYEGVGVDHP
QIKKALQFIQEEQEDDGSWYGRWGVNYIYGTWQVLRGLRALNINMNQPWLLKARDWLESVQH
EDGGWGERCNTYDDPVFKGQGPSTASQTAWAVMGLCTFDDPQRPSLMRGIDYLIKTQNSDG
SWTEHEITGTGFPRVFYLKYDMYRNSWPLLALATYRNLYASSEKTANGHTNGHSVQLPEALKT
PPAFK

>seq_ID 126
MNKKSAMKLKKKAKNHVVSLLQPTDALNRVMKRFRSLQSPEGYWVFALEADVTIPSEYIMFNR
FLGRKMDKGLAERLGNYIRAKQMADGGWPLHDNDGPVNISASVKAYMALKMLGDNKDAEHM
VRARQIILAKGGAETANVFTRICLATFGQIPWHCPPAMPIEIVLLPKWFFFHLDKVSYWSRSVIYP
LLIIYAKQPVCRLRPEEAVPELFCKPAEEHIHIDKYRDKGWRKNLFILLDRVLKRTIHLVPKSINKK
ALNYAEKWTREHMAGRGGIGAIFPAMANAVMALSLLGYDESDPDFARGMQSVDDLMVDKFHV
PEKSPWEHTVITGGAELSAAPELDISPDHGTAENLEQAMCQPCNSPIWDTCLTLSAMMEAGEN
QDSKSTQQALNWLWDQQIFFRGDWISKAPKLEGGGWAFQFENTFYPDLDDTAMVLMAMCRA
GVLDQPEHRENFIKGVNWLIGMQSSNGGWAAFDIDNCAEYLNDIPFADHGALLDPPTSDLTAR
VIELLGVLGYDKSFRPIKDGIEFLKKEQEDDGSWFGRWGVNYIYGTWSVLCGLRQAGEDMNSS
YVCKAVEWFENHQNKDGGWGESCLSYNDKNYAGLGDSTASQTAWALLGLMAAGRVHSKAV
SRGVRYLLDTQKDDGSWDESLFTGTGFPRVFYLRYHGYSQYFPMWALGVYQRFSADEDTKQI
MMRRKSPLDLGRKW >seq_ID 114
MIFTDTPTGSTQNRLDVAIRRAQQNLLRLQHNEGYWCGELFVDSTLCSDYVLFMHWADEIDPV
MEEKCVAHIRRRQLEDGGWNIYEGGPSDVNATVKAYFALKLAGHAPTQPWMQEARACILRLG
GIPKMNTYAKLYLALLGQFPWRYLPTVPVEIMFMPRWFFFDIYEVSSWSRAMLMPLAILNHYKP
TKHLPADKQLHELYPIGSEESDLGLGMQKPRFSWPNFFLFCDRLIKIMHSLPWKPWKRAALAR
AEAWMTQRMGEGSDGLAAIFPAMLNSMIALRTLRYSREHPLYVKAKNDFAGLFVDDPQDFRIQ
PCLSPVWDTAINLVALLESGLDPHDPKIEAAVNWLKEKEVRINGDWYVKNHHVPPSGWAFEFN
NVYYPDTDDTMMVLAALARAGAHEESAPVETKAMFERALKWLLSFQCRDGGWAAFDKDVTQ
GWLEDVPFADHNAILDPTCSDLTGRVLELLGLIDYDRNCTPVRRALKFLRDTQEDDGSWYGRW
GVNYIYGTWQVLRGLRSIGEDMRQQWIVRARDWLESCQNEDGGWGETCASYDDPTLKGKGP
STASQTAWALMGLIAAADPTEPGAFDRKSIRQGVDYLLSTQVADGSWVEPEVTGTGFPRVFYL
RYDMYRNNFPLMALATYRKAREGKLPVRQRE >seq_ID 194
MKKATRSVFSLLDGGKISDSGSRGDSRHAGSRLDSVTKSAAALLASRQNPDGHWVFDLEADV
TIPAEYVMMRCFIGEPLDSDMASRLSAYLLERQLPDGGWPLYAVDGNANISATVKAYFALKLLG
HDKYAPHMVSARRMILAQGGAERSNVFTRITLALFGQVPWHTTPAMPIEIMLLPKWFFFHLSKV
AYWSRTVIVPLLILYNKQPVCRLGYSEGIAELFSTSPDMLVHLDHFRYRAWRKNAFIVLDRLLKR
TMHLVPGRIKRRALEEAERWTRERMKGDGSIGAIYPAMANAVMALKTLGCGDSDPDYLRGLR
AIDRLLIHGKPEAGALPADGAGTLFPVLDGASSAAVDLYPASLSDTAKSHAFSFCQPCNSPVWD

Enzyme Sequences

TALSLTALSEAGGGGYSPERAMEWLFNRQIATQGDWTERCPGLECGGWAFQYENALYPDVD

DTAKVLMSLFRAGALERGEYPEKIAKAVRWVLGMQGADGGWGAFDVDNNHFYLNDIPFADHG

ALLDPSTADLTGRCIEMLGMLGHGPDYPPITRGIEFLREEQEPFGGWFGRWGVNYIYGTWSVL

SGLSQAGEDMGRPYVRKAVEWLVSCQNDDGGWGETCASYDDPSLAGSGASTASQTAWALL

GLMAAGEADHAAVRAGIAYLADSFADGWDERHFTGTGFPRVFYLRYHGYSLFFPVWALGVYA

RHREGGKTVQEQVRERGVNGVFDFVMGGSA

>seq_ID 154
MMANATDTIELPPSRAADRIVPMTDIDQAVDAAHAALGRRQQDDGHWVFELEADATIPAEYVLL

EHYLDRIDPALEERIGVYLRRIQGDHGGWPLYHGGKFDVSATVKAYFALKAIGDDIDAPHMARA

RAAILDHGGAERSNVFTRFQLALFGEVPWHATPVMPVELMLLPRKALFSVWNMSYWSRTVIAP

LLVLAALRPRAINPRDVHVPELFVTPPDQVRDWIRGPYRSQLGRLFKYVDIALRPAERLIPDATR

QRAIKAAVDFIEPRLNGEDGLGAIYPAMANTVMMYRALGVPDSDPRAATAWEAVRRLLVELDG

EAYCQPCVSPIWDTGLAGHAMIEAASGPEGIRPEDTKKKLAAAAEWLRERQILNVKGDWAINC

PDVPPGGWAFQYNNDYYPDVDDTAVVGMLLHREGDPANDEALERARQWIIGMQSSNGGWG

AFDIDNNLDFLNHIPFADHGALLDPPTADVTARCISFLAQLGHPEDRPVIERGIAYLRTDQEREG

CWFGRWGTNYIYGTWSVLCAYNAAGVAHDDPSVVRAVDWLRSVQREDGGWGEDCASYEGA

TPGIYTESLPSQTAWAVLGLMAVGLRDDPAVMRGMAYLTRTQKDDGEWDEEPYNAVGFPKVF

YLRYHGYRQFFPLLALSRYRNLASSNSRHVAFGF

>seq_ID 156
MLIYSDILEKEDRVSETLSRQSVEPDEINHAIEGAQAALGGKQKSDGHWVYELEADATIPAEYVL

LEHYLDRIDPEKQAKIGVYLRRIQGHHGGWPLYHDGGFDLSATVKAYFALKAIGDDINAPHMRIA

REAILDHGGAARTNVFTRIQLALFGEVPWDATPVMPVELMLLPRKAFFSVWNMSYWSRAVIAP

LLVLNALRPKAINPRGIHVQELFVKPPSEVKDWIRGPYRSVWGRFFKHLDSALRPVLPLIPRSVH

KKALKAASDFIEPRLSRGGLGAIYPAMANVVMMYRAQGVPDSDPRAKTAWDAIQDLLVDHGDE

IYCQPCVSPVWDTGLSGLAMIEAASGPAGTKTKETLAALKKSAEWLREHQILDVKGDWAINAPD

LRPGGWAFQYENDYYPDVDDTAVVAMLLHRVDPENSREAISRAREWIIGMQSTNGGWGAFDI

DNDHELLNHIPFSDHGALLDPPTADVSARCISFLAQLGDPDDRPVILKAIEYLRSEQEPEGCWF

GRWGTNYIYGTWSVLCALNIAGVPHDDPMVLRAVNWLESVQRPDGGWGEDCATYEGGTAGT

YKKSLPSQTAWAVLALMAVGRRESEAVKRGVAYLVSQQNEKGEWQEEAYNAVGFPKVFYLR

YHGYKQFFPLTALARYRNLGVSNSGKVEYGF

>seq_ID 74
MEGASPTASNRISQYAVDLRAKARAAVASTCDWLLSHQHADGHWCAELEGDSILQSEYILLLA

WLGKERTEIARRCAAHLLKQQEPNGAWTQFPGAPIDVGSSVKAYFALKLTGHDAAADYMVRA

RNAILEAGGADKVNSFTRFYLALLGQIPFELCPAVPPEMVLLPNWSPINIYRISSWSRTIFVPLSIV

WAHRAARDIVEDVSIHELFIRKPEDWPELRCPGLEKPAGLFSWDRFFRTADSGLKLLEKYGLRP

LRKRALRQAQQWMLDRFQQSDGPGAIFPPIVWSAIALRTLGYAEDSPEIQYCLDHLERLVLEDG

ETTKLQPCKSPVWDTSITLRALAAAGLGLAQEPTCRGVEWLLSKEVRVPGDWTNNVDCEPGG

WFFEYENAFYPDNDDTSMGIMALADQLAAANITLEVHPGETLANTSVVVGGRGIAEQLAGSSA

AMMEQAAAATRRAVAWMVAMQNKDGGWGAFDKNNDAEFLCHVPFADHNAMIDPSTPDLSA

RVIESFGRLGVTIESPGKLGDTVRRAVAYIRANQLSDGSWFGRWGVNYIYGTWQCLVGLRAVG

Enzyme Sequences

VPANDPAIEQGKLWLLAHQQACGGWGESCETYEDPSLRGQGSPTASQTAWALLGIIAAGGAN

LAEVVHGVQYLMDTQREDGAWDEIEFTGTGFPRVFYLKYHYYPIYFPLLALAEWNRATARS

>seq_ID 326
MFDTISFDFDALDQAISRAHARLSAEQRADGHYVYELEADATIPAEYVLLEHFLDRIDPELEARIG

VFLRGIQGNSPQNPGGWPLFHDGAMDISASVKAYFALKAIGDDPDAPHMRRAREAILARGGAA

RTNVFTRIQLALFGAVPWRACPVMPVEIMLLPDWFPITIWKISYWSRTVIAPLLVLLTERPIARNP

RNVRIDELFVTPPDQVTDYIRGPYRSNWGYLFKAIDSALRPLERHFPARSRKRAIQAAIDFITPRL

NGEDGLGAIYPAMANTVMMYHTLGYSPDHPDYATAWASVRKLVTDASYRFEGASYVQPCLSP

VWDTSLAAHALAEAGSPGDAQLAAACDWLIPRQILDVKGDWAYRKPDAPPGGWAFQYNNAH

YPDVDDTAVVGMILDRNGDPAHREAVERARQWILGMQSRSGGWGAFDSDNEFHYLNHIPFAD

HGALLDPPTADVTARCISFLAQLGHAEDRPAIERGVAYLRREQEQDGSWFGRWGTNYIYGTW

SSLCALNAAGVAQDDPMMVRAVEWLLARQRPDGGWGEDCETYAHAKPGEYHESLPSQTAW

ALLGLMAAGQAEHEAVARGIAWLQSVQEDDGSWTEQPYNAVGFPRVFYLRYHGYPRFFPLLA

MARYRNLARGNSRQVQFGF

>seq_ID 192
MDKIKMKNINQPKFRVFRGGQKAATPCPGTTNERRGALDRGRLSASLKHSREWLLSLQADAG

NWVFALEADTTIASEYVMLQRFLGRPLAPELQQRLANYLLSRQLPDGGWPLYAEDGFANISTT

VKAYLALKLLGYPTHCDPLVRARQIVLALGGAEKCNVFTRIALALFGQIPWRTTPAMPVEIMLLP

RWFYFHLSKISYWARTVVVPLLILYAKRPVCRLEPWEGIPELFVTPPDKLGYLDVCKPGQWRKN

VFIWVDRLTRKMVRCVPRRLHNLALRAAETWTREHMQGAGGIGAIFPAMANAVMALRTLGCS

PDDADYQRGLKALDDLLIDRCDVPPREDTPVSPCWCTGTSAAPMLDPSPAGSHAQGGDQGIC

QPCASPIWDTGLALTALLEGGLDARHPAVDRAVRWLLDQQVDVKGDWAQRVPNLEAGGWAF

QFENALYPDLDDTSKVLMSLIRAGAMDNPGYRQELSRAINWVIGMQNSDGGWGAFDVDNNYL

YLNDIPFADHGALLDPSTADVTGRCIEMLAMAGFGRDFLPIARGVDFLRREQEDFGGWYGRW

GVNYIYGTWSALSGLIHAGEDLQAPYIRQAVGWLESVQNPDGGWGETCYSYDDPALAGRGVS

TASQTAWALLGLMAAGEVDNLAVRRGIQYLVEEQNRAGGWDERHFTGTGFPRVFYLRYHGYS

QYFPLWALGLYERLSSGNPSRQQMVRRAGPAGLHLPVLDRRKKLRRKRKA

>seq_ID 72
MKSEEVTIKPAVGLEKDELNAAITRSQSFLLCEQKPEGYWVGELMVDSTIVSDTIAYHHWNGKV

DPEWQRKAVNHILSMQLPEGGWNIYQNGPPEVNATIKAYLALKLAGIPITDPRMLKARQVALTL

GGVPRMNTFSKLYLALLGLWPWKYVPTIPCEVLLLGKWFHVNIWDMSNWSRAMIVPLAIINHYK

PTRPVKVDLSELFLEGFHERDLALPKDPQSFTWRNFFLGLDQLHKFAELWVNAGIHPFRRLALK

KCEQWMLERFEGSDGLAAIFPAMLNSLIALKSLGYPDDHPEVLRAERELKKLEHETKDTVRIEP

CLSPGWDTAIAAMCLRESGVPAEHPRLKKAGDWLVNREVRFKADWHHKNPVDVEPSGWVFQ

FNNKWNPDLDDTAMVLLALRLIPTDHPRRRDEAFQRGLKWLLAFQCRDGGWAAYDKDCTKNI

LEKVPFADHNAMLDPECADITARVLELLGFEGYALDHPQVQEAVEYLREHQETDGSWYGRWG

VNYIYGTWQTLRGLWALKMDMNQPWLLKARDWLESVQLPDGGWGERCNTYDDPVFKGQGP

STASQTAWAVMALCTFGDPKRPSLVRGIQYLIENQNEDGSWTELETTGTGFPRVYYLKYDIYR

NTWPLLAMATYRKMLDPKEVRVK

Enzyme Sequences

>seq_ID 145
MNKHKGTFSVIEGGKTTQARGSETCAIMDAADLEKVTSVAASQLAGQQQDDGHWVFDLEADV
TIPAEYVMLQRFIGREIDPEISERLAAYMQERQLPDGGWPLYAVDGNVNISASVKAYFALKLLGH
DKNAPHMVRARQLILSLGGAAKCNVFTRITLATFGQIPWHTAPAMPIEIMLLPRWFFFHLNKVAY
WSRTVIVPLLILYATQPICRLQYNEGITELFTTPPDMLVHLDKFRHHAWRKNVFIALDRVLKRTM
HLVPGRIKQHALAEAERWTRARMQGDGGIGAIYPAMANAVMALKTLGCSDDDADYLRGLEAV
DNLMVHRNLKTGTIPMDDDSGGIAIDNSSAAPELSPTYLTDTAGNTEFSFCQPCNSPIWDTCMS
LSALCESGYAENNSGVTDRAIKWLFSQQIATPGDWSEKCPGLESGGWAFQYENSRYPDVDDT
AKVLMSLFRAGALEKPEYREKIERAIRWVQGMQSTDGGWGAFDVDNDYFYLNDIPFADHGALL
DPSTADLTGRCIEMMGMLGHGPDYPPIARGIAYLKKEQEPFGGWFGRWGVNYIYGTWSVLSG
LHQAGENMDAPYVRKAVEWLISCQNSDGGWGETCASYDDPSLAGSGASTASQTSWALMALM
AAGEWRHSAVRNGVRYLTESYCNGWNEKQFTGTGFPRVFYLRYHGYSLFFPVWALAVYSRYI
NGTATVQEKVREKQFRQCLMV >seq_ID 127
MLPYNQDFYNEDEALKDDHCEGAGNVSNPPTLDEAIKRSQDFLLSQQYPEGYWWAELEGNPT
ITSHTVILYKILGIEDEYPMDKMEKYLRRMQCIHGGWELFYGDGGQLSVTIESYVALRLLNVPPT
DPALKKALKFIIDKGGVXKSRMFTKICLALLGCFDWRGIPSLPPWVMLLPGWFLSSIYETACWA
RGCVVPLIVVFDKKPVFKVSPEVSFDELYAEGREHACKTLPFCGDWTSHFFIAVDRVFKMMER
LGVVPFQQWGIREAEKWLLERQEDTGDFLGVYPPMFYSVVCMKTLGYEVTDPVVRRALLSFK
KFSIERADECSVQSSLSPVWDTALVVRSLVESGLPPDHPALQRAGEWLLQKQITKHGDWSFKN
QSGVAGGWAFQFFNRWYPDLDDSAVVVMALDCLKLPNEDVKNGAITRCLKWISSMQCKGGG
WAAFDKDNHQHWINSTPFSDLKAMVDPSTTDISARVLEMVGRLKLHGTSFDEAHFLPPESIAR
GLVYLRREQENEGCWFGRWGVNYIYGTCGALVALSLVAPMTHEEEIARGARWLVQVQNMHG
KKINGPQDGGWGETCFSYNDPALKGQGDVSTASQTAWALQGLLAAGDALGKYEVESIGHGV
QYLLSTQRKDGSWHESQFTGGGFPIHFYLRYHFYAQHFTLSSLARYRTRLQASKIKPPIP >seq_ID 166
MNTEPRFSAPETLRAIAGAGRALGRHQRRDGHWVFELEADATIPAEYVLLEHYMDRITPERQA
RIGAYLRRIQGEHGGWPMFHAGEFNISASVKAYCALKAIGDDPQAPHMVRARQAILGHGGAER
ANVFTRIQLALFGAIPWRGVPVMPVEIMHLPKWFFFNIWAMSYWARTCVVPLLVLQARKPRAR
NPRQVSFDEIFRTEPDEVRDWIRGPYRSRWGVVFKHIDTVLRWTEPLFSKVARESAIFKAVDFV
EERLNGEDGLGAIYPAMAYALMMYDVLGYPEDDPRCVTIWKAIDKLLIETDEEVYCQPCVSPV
WDTSLSGHAMIEAARTGGIEAQAELDAACDWLVARQVKDVRGDWAETRPDAEPGGWAFQYR
NDHYPDVDDTAVVAMLLHRNGRPEHAEAIEKARRWVVGVQSRNGGWGAFDADNDREFLNHI
PFSDHGALLDPPTADVTGRCISFLSQLGHEEDRPVIERALAYLRAEQERDGSWYGRWGTNYV
YGTWTVLCGLNAAGIPHDDPMVRRAVDWLVSIQRADGGWGEDERSYDVGHYVENAESLPSQ
TAWAMLGLMSVGQADHPAVLRGAAYLQRTQGPDGEWQERAYNAVGFPRVFYLKYHGYRLFF
PLFALSRLHNLQRGNSREVSFGF >seq_ID 21
MSGEVRVAGDALAEDAGRAAAAASQYLYRTQQRDHWRAELESNVTVTAEYVLLRQALGLDLE
ERRDALVRYLCSRQKADGSFGIASTLPGDVSTTAEAYLALRLLGLDREDERLRAAERFIRGAGG
LARVRVFTRINLALFGLFPWEAVPTVPAELIFLPRWAPVNVYRLASWARSTMVPLFVLFHHRPV

| Enzyme Sequences |
| --- |
| FALPGGAGSDWLDHLWLGPGDKRVPYRTSVMETVRRHGPGWKAFFNAADAWLRVHDRLRH |
| LPPLGRLRTEALRACEEWILARQEASGDWAGIFPPMLNGVLALHVAGHGLDAAPVRRGLEAIE |
| RFAVSDREGFRIEACQSPVWDTILALIGLLDSGESPTDPRLVAARRWIEGMQLTNDWGDWKVY |
| DPRGEPGGWAFEYANSWYPDVDDTAAVIVGLLKHDPASRAGETVRRAAAWVASMQNRDGG |
| WAAFDNNNDRLFLNEIPFSDMDSLCDPSSPDVTGRVLEAFGMLDAPHLRAACRRGVAYLRRA |
| QEPEGSWYGRWGVNYVYGTSNVLNGLARQRVPASDPMVARALGWLDSVQNADGGFGEGLE |
| SYADRAAMGRGPSTASQTAWGVMGLLAYRAADDAAVRRGIAWLVERQLADGEAQGSWEEE |
| AFTGTGFPRHFYLRYHLYRHYFPLMALGRFCAQGRG |
| >seq_ID 111 |
| MSYEWTEPVRPGRRHAVSPVQNFCQSLAPAIQRACDALFSQQAADGFWCGELTADTTLESDY |
| ILLQLWLNQPDDHGWNPPTRPRIDRAGRSILERQLPDGGFNIYAGGPSEVSATIKAYCALKLAG |
| LDPHSPPLRRARERILALGGLQAANSYVKINLSLFGLYPRKHVPSVPPEIVMLPGNVLYEMSSW |
| TRSILVPLSIVQARGSNRRAPNGFNLDELLLPGVKLALPKRKGLAVLFHHLDRMFKVWEKRGSE |
| RIRGAAIREAERWLIARTHYTEGLGAIYPAMMYFIMALDALGYAEDHPDRSEAIRHFESLLIETDD |
| RFLFQPCVSPVWDTAICAFALGEAGNTDDPRMTLAADWLISKEVRRKGDWSIKRPDTEPSGW |
| APEFANEFYPDIDDTAMVLLALMHANGSNPEAQAAAERRAVNWLLAMQSSDGGWAAFDVDN |
| NWAMLNQVPFADHNAMLDPTCPDITGRVLECLCRRGMAGHDAARRGVAYLLQAQEKDGSWY |
| GRWGVNYIYGSFLAMRGLTTSGAPGSQDAVDRAARWLRAIQNPDGGWGESCASYARDGYVA |
| APSSASQTAWALLGLCAAGDRDSAQFRRGVEYLLTLQAPDGKWPEGATTGTGFPNVFYLTYA |
| MYRDYFPLLALSQV |
| >seq_ID 157 |
| MPKDIPADLASEAISGDMLEQAVLRASMALHRKQQTDGHWVFELEADATIPAEYVLLEHFLDRI |
| DDDLERKIGVYLRRIQGDHGGWPLFHEGAFNLSASVKAYYALKAIGDDPDAPHMRRAREAILAA |
| GGAERSNVFTRIQLALFGQIPWRGVPVMPAELMIAPKWFPINMWKVSYWSRTVIAPLLVLMDR |
| KPKARNPRNVHVRELFLHDPDRIRDWIRGPFRSGWGHFFKYLDSVLRVVEPVALKPMRPRSIR |
| LAVDFVRERLNGEDGLGAIYPAMANSVMMYDVLGYSPDHPEAAIAWESVRKLLVIKEDEAYCQ |
| PCLSPIWDTGLSGHAMAEAEGAVSPGVAAACDWLRNRQITDVVGDWAEIRPGVQPGGWAFQ |
| YNNAHYPDVDDTAVVAMLLHRQGDPAHEESIRKAREWIIGLQCRDGGWGAFDADNDKDYLNH |
| IPFADHGALLDPPTADVTARCISFLAQLGNPEDKPVIDRAMAWLRKEQEADGSWFGRWGTNYI |
| YGTWSVLCAMNVAGMPHDDPAIRRAVNFLVATQREDGGWGEDEETYDPASGAQPGRYKEST |
| PSQTAWALIGLMAAGEAEHEATRRGIAYLQATQKPDGEWDEAAYTAVGFPRVFYLKYHGYRQ |
| FFPLMALSRYKNLRSSNMKKVSFGF |
| >seq_ID 205 |
| MNQAATITRPQDETLTTSARRPAQPALPDPLDAGIAHVVESLLAQQQSDGHWVYELEADATIPA |
| EYILMVHYLGETPDLVLEGKIANYLRRIQNADGGWPLFHAGASDISASVKGYFALKMAGDNPEA |
| EHMRRARAAIHAMGGAEASNVFTRTLLALYGVMPWQAVPMMPVEIMLLPEWFPFHLSKVSYW |
| ARTVIVPLLVLNSLRPQARNPRKIGIDELFVRPCQATRLPRRAPHQSPLWVGVFRTLDAVVRMA |
| EPLFPRGLRQRAIERAREFTVERLNGEDGLGAIFPAMVNSVLMFDVLGVPESDPNRAIARRSID |
| KLLVIKDDEAYCQPCLSPVWDTSLAAHALLEVGEPRTIAAAARGLDWLLPLQELELRGDWTVRR |
| PNVRPGGWAFQYANPHYPDVDDTAVVAAAMDRVDKGDRSNRYDEAVSRACEWIVGMQSSN |

Enzyme Sequences

GGWGAFEPENTHLYLNNIPFADHGALLDPPTADVSARCLAMLCQLGQMPANSEPAARALRYLL

DEQEADGSWFGRWGTNYIYGTWSALCGLNAAGIGTDAPEMKRAAQWLLSIQNEDGGWGESG

DSYKLEYRGYEKAPSTASQTAWAMLGLMAAGAGDHPALVRGVEYLLRTQASHGFWNDEPYFT

AVGFPRVFYLRYHGYSRFFPLWALARFRNLLRDGNRAISWGL

>seq_ID 218
MKTDGNTTLDTTISMEELERTVKSAYEALAKDQQDDGHWIYELEADVTIPAQFILLEHTLDKIDE

ELEQKIANYLRRCQSREHWGWPVYYGGEFNISASVQAYFALKMTGEDINAPHMVRAREAILAH

GGPEYANVFTRIQLSLFGEASWLATPFMPVEIMLLPRWMYFSIWNMSYWSRTTVAPLLIVADLK

PKAINPRNVHIPELFPTPPDKVKTWIHGPFRSKWGHVFKFIDTAIRPFTRFVPSFLHKKAYKAAL

DFIEPRLNGVDGLGAIYPPMSYSAVMYRALGIPDDDPRAATNWEALKGLLVIKEREAYCQACVS

PVWDTALSGHALMEASFGPDGINADRTEKLIDRAAHWLRAHQVLNVVGDWAINNPNLQPGGW

AFQYGNDYYPDVDDTAVAAMLLHRQNLPENEEALDRARKWIIGMQSSNGGWGAFDIDNDKQI

LNDIPFADHGALLDPPTADVSARCISLLAELGHPEDRPVIERGIKYLRKEQEEDGSWFGRWGTN

YIYGAWSVLCAFNASGVPHDDPSVLKCVNFLKSVQREDGGWGESCETYEGSAHGVYTESLPS

QTAWAVLGLMASGRRTDPAVKRGIVWLIQHQQDNGEWAEEPFNAVGFPRMFYLHYLGYKQF

FPLLALARYRHMEKSGTNNVSFAF

>seq_ID 11
MLPYNQDHHFGKVAENATMPPTLDEAIERSQDFLLSLQYPEGYWWAELEANVTLTAQTIMLYKI

LGIDHKYPIHKMKTYILRTQRAHGGWEIFYGDGGCLSTTIGAYMALRILGVPKTDPVLQKALKLIH

SKGGVTKSRMFTKICLALLGCYDWKGIPSLPPWLVLLPSWFPFSLYDTASWVRGCVVPLTIIFD

KKPVYKLNPLLCLDELYSEGKGKARVHLSFIPGDWTSNFFVGLDHVFKYMENLGVVPFRQWGI

KEAERWTLERHEDSGDFHGIYPPMFYSIVSYSLLGYEITDPVVHRALESMRGFTVEREDECVV

QSCISPMWDTAFVIRSLAESGLQPDHPALQKAGEWLLQKQATQHGNWFYKKRTGRAGGWAF

QFFNRWYPDVDDSAAVSMALNAIKLQDDDVKKGAIKRCAEWISVMQCKDGGWAAYDCDNDR

EWLNCTPFGDLKAMIDPNTVDVTARVLEMVGRVKEAGDASAILPPRAIARGLAYLRREQETEG

CWYGRWGVNYIYGTSGALMALALVAPSTHKEEIERGARWLVEVQNKRGTKGANGYSHTNGA

REGGVAMNGNCKNMGAPEDGGWGETCFSYNDITLKGRNEVSTVSQTAWALQGLLAAGDALG

KYEVESIEHGVQYLLSTQRKDGSWCEKHFTGGGFPRFFYIRYHLYAGHFPLSALARYRDRVRA

GKMAK

>seq_ID 214
MDATAPLRDPGAPSAENCSVDRRELDDVIGESCRWLGERQNQDGHWVFELEADATIPAEYILL

NHFLDEIDDAREARIASYLRAIQGKHGGWPLFHDGDFDMSATVKAYYALKLTGDGVDEPHMVR

ARQAILEHGGAERTNVFTRFTLAMFDQVPWRACPVTPVEALLLPRFAPFHWSKVSYWSRTVM

TPLMILYSRRARAVNPRGIGVRELFRRDPEVIRDWLKNPTGHWIGDALIQIDKVLRVIEPAIHWAF

RDRAEKWALDFIEERLNGRDGLGGIYPAIANTLMAYHTLGYAKDHPGYRIAREAVDGLCTPHAK

GEYVQPCLSPVWDTCLASHAIQEAGQSAGDRAVDQSNAWLRERQVLDVVGDWKSNRGHLRP

GGWAFQYNNPHYPDVDDTAVVVMALARSKEDEANREAIARAEEWIIGMQSSNGGWGAFDAE

NEHDFLNHVPFADHGALLDPPTVDVSARCLGMLAQLGRPKTDPVVARGLDYLWREQEADGS

WFGRWGTNYIYGTWSALNAFNAVEWDMTDPRICKAVDWLKSRQRDDGGWGEDCATYWKER

Enzyme Sequences

RSVSKASTPSQTAWAVLGLMAAGEVDSPEVERGIRYLLEAPRDGGKWEEELYNAVGFPRIFYL

RYHGYSAYFPLWALARYRNLTSGNCKRTIHGM

>seq_ID 73
MPEEAILTETHPLDATTIETAITRARKALLGEQRADGHFVFELEADVSIPCEYILFYHFIGRPAPAE

LEAKIGHYLRARQSAEHDGWPLFQDGAFNISSSVKAYFALKAIGDTPDMPHMQRARTAILAHG

GAAAANVFTRSLLALFGLIPWHGIPVMPIEIMHLPEWFPFHIAKISYWGRTVLVPMMVVHALKPK

PANTCTIRIDELFVIPPDQVRHWPGSPGKRFPWTAIFAGIDKVLQIAERYFPRRSRQSAIDKAVA

FVTKRLNGEDGLGAIYPAMAYSALMYLSIGRSLSDPHIQLVLKAIDKLVVVKDHEAYVQPCVSPV

WDTALASHALMEAGDGDKPILDSLKKGLAWLKPLQVTDIAGDWAWKKPDVKPGGWAFQYGN

AYYPDLDDTAVVVMAMDRARDRWPEIDEDNFRPSIARAREWIVGLQSENGGFGAFDADNDRD

YLNAIPFADHGALLDPPTADVTARCISMLTQLGEKPENSETLRRAIAYLFAEQEKDGSWFGRWG

LNYIYGTWSVLCSLNAAGIAHDAPEVRRAVAWLRTIQNEDGGWGEDAESYALDYAGYQQAPS

TSSQTAWAVLGLMAAGEKDDPAVARGIAYLTRTQGEDGFWTEKRFTATGFPRVFYLRYHGYS

KFFPLWAMARYRNLHNGNHASVLTGM

>seq_ID 103
MNDMTEMHTLDATAVPAAPAAADAPAPSAATTGLDAAVARATDALLAAQNADGHWVYELEAD

STIPAEYVLLVHYLGEEPNAELEQKIARYLRRIQQPDGGWPLFTDGAPNISASVKAYFALKVIGD

DENAEHMQRARRAIHAMGGAEMSNVFTRIQLALYGVVPWYAVPMMPVEIILLPQWFPFHLSKV

SYWARTVIVPLLVLNAKRPVAKNPRGVRIDELFKSAPVNTGLLPKQPHQHAGWFAFFRAVDGV

LRLADGLFPRYTRERAIRQAAAFVDERLNGEDGLGAIYPAMANAVMMYAALGYPEDHPNRAIA

RQSIEKLLVVGEEEAYCQPCLSPVWDTSLAAHALLETGDERAREAAVRGLDWLVPRQILDVRG

DWISRRPHVRPGGWAFQYANAHYPDVDDTAVVVMAMDRVAKHDQTDAYRESIARAREWVVG

MQSSDGGWGAFEPENTQYYLNNIPFSDHGALLDPPTADVSGRCLSMLAQLGETSASSEPARR

ALDYMLKEQEPDGSWYGRWGMNYIYGTWTALCSLNAAGLGHDDPRVKRAAQWLLSIQNPDG

GWGEDGDSYKLDYRGYERAPSTSSQTAWALLGLMAAGEVDNPAVARGIGHLLGTQREHGLW

DETRFTATGFPRVFYLRYHGYRKFFPLWALARYRNLKRAGAARVTVGM

>seq_ID 95
MNDMTEMHTLDAAAAPAADAPAVTAVTAGLDAAVARATDALLAAQNADGHWVYELEADSTIPA

EYVLLVHYLGEEPNAELEQKIARYLRRIQQPDGGWPLFTDGAPNVSASVKAYFALKVIGDDENA

EHMQRARRAIHAMGGAETSNVFTRIQLALYGVVPWYAVPMMPVEVMLLPQWFPFHLSKVSYW

ARTVIVPLLVLNAKRPVAKNPRGVRIDELFKSAPVNTGLLPKQPHQSTGWFAFFRAVDGVLRLV

DGLFPRYTRERAIRQAVAFVDERLNGEDGLGAIYPAMANAVMMYAALGYPEDHPNRAIARQSI

EKLLVVGEEEAYCQPCLSPVWDTSLAAHALLETGDERARDAAVRGLDWLIPRQILDVRGDWIS

RRPHVRPGGWAFQYANPHYPDVDDTAVVVMAMDRVAKLDQSDAYREQIARAREWVVGMQS

SDGGWGAFEPENTQYYLNNIPFSDHGALLDPPTADVSGRCLSMLAQLGETNASSEPARRAFD

YMLKEQEPDGSWYGRWGMNYIYGTWTALCALNAAGLGHDDPRVKRAAQWLLSIQNQDGGW

GEDGESYKLDYRGYERAPSSSSQTAWALLGLMAAGEVDNPVVARGIDYLLGAQCEHGLWDET

RFTATGFPRVFYLRYHGYRKFFPLWALARYRNLKRANTTRVTVGM

>seq_ID 106
MNDLTDMPTLAADSAAADLDAAVARATDALLAAQQADGHWVYELEADSTIPAEYILLVHYLGET

PNLELEQKIGRYLRRIQQPDGGWPLFTDGAPNISASVKAYFALKVIGDDENAEHMQRARRAIHA

| Enzyme Sequences |
| --- |

MGGAEMSNVFTRIQLALYGAIPWRAVPMMPVEIMLLPQWFPFHLSKVSYWARTVIVPLLVLNAK
RPIAKNPRGVRIDELFIDPPVNAGLLPRQGHQSAGWFAFFRVVDHALRAVDGLEPSYTRERAIR
QAVAFVDERLNGEDGLGAIYPAMANAVMMYDALGYPEDHPNRAIARRSVEKLLVVHDDEAYC
QPCLSPVWDTSLAAHALLETGDPRAEDAVVRGLEWLRPLQILDVRGDWISRRPNVRPGGWAF
QYANPHYPDVDDTAVVVMAMDRVEKLRHSDAYREAISRAREWVVGMQSSDGGWGAFEPEN
TQYYLNNIPFSDHGALLDPPTADVSGRCLSMLSQLGETAANSEAARRSLDYMLKEQEPDGSW
YGRWGMNYVYGTWTALCSLNAAGLGPDDPRVKRGAQWLLSVQNKDGGWGEDGDSYKLDY
RGYEQAPSTSSQTAWALLGLMAAGEVNHPAVARGIDYLIAEQKEHGLWDETRFTATGFPRVFY
LRYHGYRKFFPLWALARYRNLKRANATRVTVGM

>seq_ID 87
MNDLTEMATLSAGAVPAGVDAAVARATDALLAAQQADGHWVYELEADSTIPAEWLLVHYLGE
TPNLELEQKIGKYLRRIQQADGGWPLFTDGAPNISASVKAYFALKVIGDDENAEHMQRARRAIH
AMGGAEMSNVFTRIQLALYGAIPWRAVPMMPVEIMLLPQWFPFHLSKVSYWARTVIVPLLVLNA
KRPLAKNPRGVRIDELFIDPPVNAGLLPRQGHQSPGWFAFFRVVDHALRAVDGLFPSYTRERAI
RQAVSFVDERLNGEDGLGAIYPAMANSVMMYAALGYAEDHPNRAIARKSVEKLLVVHDDEAYC
QPCLSPVWDTSLAAHALLETGDARAQEAVLRGLEWLRPLQILDVRGDWISRRPNVRPGGWAF
QYANAHYPDVDDTAVVVMAMDRAQKLTQSDTYRESMARAREWVVGMQSSDGGWGAFEPEN
TQYYLNNIPFSDHGALLDPPTADVSGRCLSMLSQLGETPLNSEPARRALDYMLKEQEPDGSWY
GRWGMNYVYGTWTALCSLNAAGLTPDDPRMKRGAQWLLSIQNKDGGWGEDGDSYKLNYRG
YEQAPSTASQTAWALLGLMAAGEVNNPAVARGVDYLVAQQNEEGLWDETRFTATGFPRVFYL
RYHGYRKFFPLWALARYRNLKRANATRVTVGM >seq_ID 107
MNDLTDMANLSAGTVPAGLDASVARATDALLAAQNADGHWVYELEADSTIPAEYVLLVHFLGE
TPNLELEQKIGRYLRRIQQADGGWPLFTDGAPNVSASVKAYFALKVIGDDENAEHMQRARRAI
HAMGGAEMSNVFTRIQLALFGAIPWRAVPMMPVEIMLLPQWFPFHLSKVSYWARTVIVPLLVLN
AKRPLAKNPRGVRIGELFIDPPVNAGLLPRQGHQSPGWFAFFRVVDHALRAADGLFPSYTRER
AIRQAVSFVDERLNGEDGLGAIYPAMANAVMMYDVLGYPEDHPNRAIARKSIEKLLVVHDDEAY
CQPCLSPVWDTSLVAHALLETGDARAEQAVLRGLDWLRPLQILDVRGDWISRRPNVRPGGWA
FQYANAHYPDVDDTAVVVMAMDRAQKLQNTDTYRESIARAREWVVGMQSSDGGWGAFEPE
NTQYYLNNIPFSDHGALLDPPTADVSGRCLSMLAQLGESALSSEPARRALDYMLKEQEPDGS
WYGRWGMNYVYGTWTALCSLNAAGLGPEDPRVKRAAQWLLSIQNKDGGWGEDGDSYKLNY
RGFEPAPSTASQTAWALLGLMAAGEVNHPAVERGIGYLIAQQNDEGLWDETRFTATGFPRVFY
LRYHGYRKFFPLWALARYRNLKRANATRVTVGI >seq_ID 212
MESGNNKQPAAAIGALDASIESATNALLGYRQPDGHWVFELEADCTIPAEYVLLRHYLGEPVDA
ALEAKIANYLRRVQGAHGGWPLVHDGGFDMSASVKGYFALKMIGDDIDAPHMAKAREAIRSRG
GAIHSNVFTRFLLSMFGITTWRSVPVLPVEIMLLPMWSPFHLNKISYWARTTIVPLMVLAALKPR
AVNRLDIGLDELFLQDPKSIKMPAKAPHQSWALFKLFAGIDAVLRTIEPLFPKRLRDHAIKLAVDF
VEERLNGEDGLGAIYPPMANTVMMYKVLGFPEDHPPRAITRRGIDKLLVIGEDEAYCQPCVSPV
WDTALTCHALLEVGGEAAVPPAKRGMDWLLPKQVLDLKGDWAVKRPNLRPGGWAFQYNNAH

| Enzyme Sequences |
| --- |

YPDLDDTAVVVMAMDRSRRATGSREYDEAIARAREWIEGMQSDDGGWAAFDVNNLEYYLNNI

PFSDHGAMLDPPTEDVTARCVSMLSQLGETAASSKAVADGVEYLRRTQLPDGSWYGRWGLN

YIYGTWSVLCALNAAGVDHQDPVIRKAVTWLASVQNPDGGWGEGAESYRLNYTRYEQAPTTA

SQTSWALLGLMAAGEVDSPVVARGVEYLKSTQTGKGLWDEQRYTATGFPRVFYLRYHGYAKF

FPLWALARYRNLRSTNSKVVGVGM

>seq_ID 101
MNDLTEMATLSAGAVPAGVDTAVARATDALLAAQNADGHWVYELEADSTIPAEYVLLVHYLGE

TPNLELEQKIGKYLRRIQQADGGWPLFTDGAPNISASVKAYFALKVIGDDENAEHMQRARRAIH

AMGGAEMSNVFTRIQLALYGAIPWRAVPMMPVEIMLLPQWFPFHLSKVSYWARTVIVPLLVLNA

KRPLAKNPRGVRIDELFIDPPVNAGLLPRQGHQSAGWFAFFRVVDHALRAVDGLFPNYTRERAI

RQAVSFVDERLNGEDGLGAIYPAMANSVMMYDVLGYAEDHPNRAIARKSIEKLLVVQEDEAYC

QPCLSPVWDTSLAANALLETRDARAEDAAIRGLEWLRPLQILDVRGDWISRRPHVRPGGWAF

QYANAHYPDVDDTAVVAVAMERAQQLKQNDAYRDSIARAREWVVGMQSSDGGWGAFEPEN

TQYYLNNIPFSDHGALLDPPTADVSGRCLSMLSQLGETPLNSEPARRALDYMLKEQEPDGSWY

GRWGMNYVYGTWTALCSLNAAGLTPDDPRVKRGAQWLLSIQNKDGGWGEDGDSYKLNYRG

FEQAPSTASQTAWALLGLMAAGEVNNPAVARGIDYLIAEQNAEGLWDETRFTATGFPRVFYLR

YHGYRKFFPLWALARYRNLKRDNTTRVTVGL

>seq_ID 112
MSAPSHVGNTLEHAAELATRKAMAYLTCLQERDGHWCAELTADTTLESDYILFQLWLYPPQDG

KWEPETRPLIRKAVNSILERQLPDGGFNICVGGPSEVSASVKAYVAMKLAGLPPEDDRMARLR

ERILALGGIQAANSYVKVNLSLFDLYPREFSPSIPPEVALLPFDLLYQMSAWTRAIVISLGIVHAAN

PRRPAPAGFNLQELWLPGVSPEFRRDPSFFTWHNTFLTVDKALKLWERYGSKAVRRRAVEKA

KTWMIERLHHSDGLGAIYPPMMYSVMALDVLGYAKDDPLRVEALRHFNNLMVDDGDRFFFQP

CFSPVWDTAIGAYALVQADPSHEAIAPAADWLIAKEVRRKGDWSVKRPNTEPSGWAFEYSNE

YYPDIDDTAMVMLALGETRASNTEAQAAACKRGLAWLLAMQSSDGGWAAFDADNNWEFLSQ

VPFADHNAMLDPTCADITGRVLEALASQGLDRNHKAVRRGAEWLIRHQENDGSWYGRWGVA

YIYGTCFALRGLAASGENDREAHILRAGEWLRSIQNADGGWGESCKSYDNRIFTGGPSTPSQT

AWAILGLIAGGDANSLSVQHGIEYLLETQRSDGSWDEQFATGTGFPRVFYLNYHMYKDYFPLL

ALASFVKARAGSNG

>seq_ID 83
MNDLTEMATLSAGTVPAGLDAAVASATDALLAAQNADGHWVYELEADSTIPAEYVLLVHYLGE

TPNLELEQKIGRYLRRVQQADGGWPLFTDGAPNISASVKAYFALKVIGDDENAEHMQRARRAI

HAMGGAEMSNVFTRIQLALYGAIPWRAVPMMPVEIMLLPQWFPFHLSKVSYWARTVIVPLLVL

NAKRPIAKNPRGVRIDELFVDPPVNAGLLPRQGHQSPGWFAFFRVVDHVLRAADGLFPSYTRE

RAIRQAVSFVDERLNGEDGLGAIYPAMANAVMMYDVLGYAEDHPNRAIARKSIEKLLVVHEDEA

YCQPCLSPVWDTSLAAHALLETGDARAEEAVIRGLEWLRPLQILDVRGDWISRRPHVRPGGW

AFQYANAHYPDVDDTAVVAVAMDRVQKLKHNDTFRDSIALAREWVVGMQSSDGGWGAFEPE

NTQYYLNNIPFSDHGALLDPPTADVSGRCLSMLAQLGETPLNSEPARRALDYMLKEQEPDGS

WYGRWGMNYVYGTWTALCALNAAGLTPDDPRVKRGAQWLLSIQNKDGGWGEDGDSYKLNY

Enzyme Sequences

RGFEQAPSTASQTAWALLGLMAAGEVNNPAVARGVEYLIAEQKEHGLWDETRFTATGFPRVF
YLRYHGYRKFFPLWALARYRNLKRDNATHVTFGL

>seq_ID 175
MLQTEAITTEGLRFRSLAPDDPLLPRVKQALKLSGQHSREEMHSDGHWCGEVKTNATTSAEH
VLLCQALDINLDADREAFISWFRCTQGADGGWSTAPDQAGDISVTVEAYLALKILGLSEDDAAM
RSARDFAIAAGGVARVRIFTRIYLAMFGLFPWAAVPELPPELILLPSRVPVSIYHWSAWARATVV
PLLIISHHRPIYALPGGKATCSDYLDELWCDPRNKMVPYNHDKPTAWRSDPFALIFTLADSILHR
LDGLRSFNPLRRFALRKCVDWILEHQEDMGDIGDIMPPLHGAMLALRLEGYPLHSDPIHRGLEA
IERFAYRDQQGKRIQTTVSAFWDTSLMLVALGDAGMASSPWLTRSLGWLQQHQRLGNYGDW
KVNNPGLKAGGFSFGYFNTWYPDVDDTASAVLAIIRQDERLVCSASVLDALNWLLGMQNTDG
GWGAFDRDNNKLFLNKIPFSDMEAFCDPSTPDVTGHVLEAFGIFLAVSARQQSPTKADVLTDRI
VSASRRAICYLSDTHVSSGGWYGRWGCNYIYGTSAVLCALAYFGSKSDTLSGVRSVKDAVNQ
AIRWLETVQNQDGGWGETVNSYKDPSRAGSGPSTASQTAWAIMALLPYLPPSTEVIQRGVEYL
LRTQTKTASQGATWHEKAYTGTGFPKYFYMGYSFYCHYFPMMALGRYAYPCPEWHENWRPK
KE >seq_ID 88
MNDLTDMATLSAGAAPAADLDAAVARATDALLAAQNADGHWVYELEADSTIPAEYVLLVHYLG
ETPNLELERKIGRYLRRIQQADGGWPLFTDGAPNVSASVKAYFALKVIGDDENAEHMQRARRAI
HAMGGAEMSNVFTRIQLALYGAIPWRAVPMMPVEIMLLPQWFPFHLSKVSYWARTVIVPLLVL
NAKRPLAKNPRGVRIDELFIDPPVNAGLLPRQGHQSAGWFAFFRVVDHVLRAVDGLFPKYTRE
RAIRQAVSFVDERLNGEDGLGAIYPAMANAVMMYDVLGYAEDHPNRAIARKSIEKLLVVHDDEA
YCQPCLSPVWDTSLAAHALLETGDPRAEDAALRGLEWLRPLQILDVRGDWISRRPNVRPGGW
AFQYANAHYPDVDDTAVVAMAMDRAQKLRQSDTYRESIARAREWVVGMQSSDGGWGAFEP
ENTQYYLNNIPFSDHGALLDPPTADVSGRCLSMLSQLGESALTSEPARRALDYMLKEQEPDGS
WYGRWGMNYVYGTWTALCALNAAGLGPDDPRVKRAAQWLLSIQNKDGGWGEDGDSYKLNY
RGYEQAPSTASQTAWALLGLMAAGEVNNPAVARGIDYLLAEQKEHGLWDEVRFTATGFPRVF
YLRYHGYRKFFPLWALARYRNLKRANATRVTVGM >seq_ID 92
MNDMTEMHTLDATAAPAGLDAAVARATDALLAAQQADGHWVYELEADSTIPAEYVLLVHYLGE
APNVELEQKIARYLRRIQQPDGGWPLFTDGAPNISASVKAYFALKVIGDDENAEHMQRARRAIH
AMGGAEMSNVFTRIQLALYGVVPWYAVPMMPVEIMLLPQWFPFHLSKVSYWARTVIVPLLVLN
AKRPVAKNPRGVRIDELFKGAPVSTGLLPKQPHQSAGWFAFFRAVDGVLRLVDGLFPRYTRER
AIRQAVAFVDERLNGEDGLGAIYPAMANAVMMYAALGYPEDHPNRAIARRSIEKLLVVGEQEAY
CQPCLSPVWDTSLAAHALLETGDARAREAAVRGLDWLVPRQILDVRGDWISRRPHVRPGGWA
FQYANAHYPDVDDTAVVAMAMDRVAKLDRTDAYRESIARAREWVVGMQSSDGGWGAFEPEN
TQYYLNNIPFSDHGALLDPPTADVSGRCLSMLAQFGETSASSEPARRALDYMLKEQEPDGSW
YGRWGMNYIYGTWTALCSLNAAGLGHDDPRVKRAAQWLLSIQNADGGWGEDGDSYKLDYR
GYERAPSTSSQTAWALLGLMAAGEVDNPAVARGVDYLLGTQREHGLWDETRFTATGFPRVFY
LRYHGYRKFFPLWALARYRNLKRANAMRVTVGM

Enzyme Sequences

>seq_ID 206
MTRKTIPASELDAAIVRARDALLDRQHPDGHWCFELECDATITAEYILMMHFVDEIDTALQARM
AKYLRAVQRLDGHGAWDLYFGGDLDISCSVKAYFALKAAGDPPDAPHMVRAREAILARGGAA
KSNVFTRILLATFGEIPWRGTPFMPVEFVLFPRWAPIHMDKVAYWARTTMVPLLVLCSIRAAAK
NPLGVHVQELFVTPPELEREYFPRKRGLQQAFLVADRVVRHLEPLIPRALRRRAIQRAVEWSEA
RMNGEDGFGGIFPPMVYSYEMMVLLDYPEDHPLRVECKAALKKLVVHRDDGSSYCQPCLSPV
WDTAWSVMALEQAPSDARTETAIARAYDWLTDRQVLDLRGDWENNAAPSTPPGGWAFQYEN
PYYPDIDDSAVVLAMLHARGKRTGQPGRYEMPVARCLDWIIGLQSRNGGFGAFDANCDRDFL
NAIPFADHGALLDPPTEDVSGRVLLALGITERPQDATARERCIQYLRDTQQPDGSWWGRWGT
NYIYGTWSVLAGLGLAGVDRKLPMVRNGLQWLRGKQNADGGWGETNDSYARPELAGKHED
GSMAEQTAWAMLGQMAVGEGDADSVHRGAAYLLDAQNEDGFWMHPYHNAPGFPRIFHLKY
HGYTAYFPLWALGRYRRLAAARASAMQTAKAESAESMTAH >seq_ID 96
MNDLSMTQTLGEVLPQTLIDDHAPVAAALATGAAPVDALDAAVTRATEAILAVQKDDGHWVYE
LEADATIPAEYVLLVHFLGETPNLELEQKIARYLRRIQLPNGGWPLFTDGAMDVSASVKAYFALK
MIGDPEDAAHMVRARECILANGGAEAANVFTRILLALFGVVTWYAVPMMPVEIMLLPKWFPFHL
SKVSYWARTVIVPLLVLNAKRPVARNPRGVRIDELFRGAPVTTGLLPRSGHQSKSWFAFFRAV
DGVLRVTDGLFPKASRERAIKAAVSFVDERLNGVDGLGAIFPAMANSVMMYDVLGYPADHPNR
AIARESIEKLLVVHEDEAYCQPCLSPVWDTSLAAHALLETGDARAEEAAERGLAWLRPLQILDV
RGDWISRRPDVRPGGWAFQYNNAHYPDVDDTAVVAMAMHRSAAVTNSNVDANAIARAREWV
VGMQSSDGGWGAFEPENTQYYLNNIPFSDHGALLDPPTADVSGRCLSMLAQLGEMPATSEPA
RRAYDYLLKEQEDDGSWYGRWGMNYIYGTWTALCALNAAGISLEDARIKRAAQWLVSIQNAD
GGWGEDGTSYKLDYRGYEKAPSIPSQTAWALLGLMAAGYVDHPAVARGIDYLQREQRDHGL
WDEERFSATGFPRVFYLRYHGYRKYFPLWALARYRNLKRTGEKRVTVGM >seq_ID 104
MNDMTEMHTLDATAAPAAPTVATGLDAAVARATDALLAAQNADGHWVYELEADSTIPAEYVLL
VHYLGEAPNVELERKIARYLRRIQLPDGGWPLFTDGAPNISASVKAYFALKVIGDDENAEHMQR
ARRAIHAMGGAEMSNVFTRIQLALYGVVPWYAVPMMPVEIMLLPQWFPFHLSKVSYWARTVIV
PLLVLNAKRPVAKNPRGVRIDELFKSAPVNTGLLPKQPHQSAGWFAFFRAVDGVLRLTDGLFP
RYTRERAIRQAVAFVDERLNGEDGLGAIYPAMANAVMMYAALGYPEDHPNRAIARQSIEKLLVV
GEDEAYCQPCLSPVWDTSLAAHALLETGDERAREAAVRGLDWLVPRQILDVRGDWISRRPHV
RPGGWAFQYANAHYPDVDDTAVVAMAMDRVAKLDRTDAYRESIARAREWVVGMQSSDGGW
GAFEPENTQYYLNNIPFSDHGALLDPPTADVSGRCLSMLAQFGETSASSEPARRALDYMLKEQ
EPDGSWYGRWGMNYIYGTWTALCSLNAAGLGHDDPRVKRAAQWLLSIQNPDGGWGEDGDS
YKLDYRGYERAPSTSSQTAWALLGLMAAGEVDHPAVARGIDHLLGTQREHGLWDETRFTATG
FPRVFYLRYHGYRKFFPLWALARYRNLKRANATRVTVGM >seq_ID 27
MAHQETMASETSISLHTLACDATKLAGTYALRQVREDGHWYGEMKSNATITAEYVFLAQALGF
SIEEDRDDLIKYFLSEQNTDGSWSLAYDFPGDVSVTAEAYFALCLLGLDRSHPAMASAREFTLS
KGGIAKVRVFTRMFFACFGLFPWSAVPELPAELILLPAAAPMSIYQLASWARATVVPMLVIRHH
RPIYALPNGRSSSNEYLDELWVDPTDKMVPYSPSLWSLWNDDLTAFGFTLADNILKALGGLRW Enzyme Sequences

FPSRKIALRHCVAWILERQEPEGDIGGIFPPLHAALFALALEGYGLESSPVRRGIDALQNTYAWR

DSTGLRIQGCISPILDTILMTIGLIDSSLPAESPLVARSSRYLKAHQQLGNEGDWRVYNGNVPSG

GFNFEYFNSWYPDIDDTAAAILAMVKQDPNLLDLGPILSAVQWILGLQNDDGGWAAFDRENNY

LFLNKIPFSDMDSFCDPSTADVTGRVIECFGLNGKNPIPRFFIDDMSSATERAIDFLSTEQEADG

SWYGRWGSNYIYGTSAVLCGLVYHLEGWDDTYPVMEKRHKVDTHAALDWLKRHQNPDGGW

GERLESYYEPRLAGNGPSTASQTAWALMGLLAYLAPTDESITRGIQYLSRTQIKEGELAGSWKE

DHYTGTGFPNHFYLCYTLYSQYFPMMALGRYTSLSGYRPLENLESTVEDHKGNSSDC

>seq_ID 28
MMTLREEGHKEGITPGKEQLTSDIEHSLKLATEYALSSIRSDGHWCGELRSNVTITAEYIFLRHA

LGLDLRTDNAAYCRYILSQQNCDGSWGLAPEYPGDVSTTTEAYLALKLLGTSPDMPAMQQAR

AFVRKAGGAEKVRVFTRIFLATFGLFPWDAVPQLPVELILLPSSCPINMYTLASWARGTIAPLLII

CHHQPVYALPEDYLDELWLDPTDKNVPYGSSLRDLLSRGDITGLAFSVVDNLLYYLNGLRSVPL

LRSYARRKCIQWILERQEPTGDWAGIFPPMHASIYAFVLEGYELNDPPVRLGIQALENFAWEDE

KGKRIQACVSPVWDTALMSIGLCDAMSPDKQILQQAITWIRNRQLLKPCGDWRIYRSKLAPGGF

SFEYENSHYPDVDDTAAIILAQLKQDPQSVASDSVIAAATWILGMQNPDGGWAAFDVENDKLFL

NKIPFSDMDSLCDTSCADITGRILEAFGLMMKRELKRPVLSPMLRHACIRGITYLASTQESNGA

WFGRWGCNYIYGTCHALGLVAPALQWLKSKQNDDGGWGEPLLSYRTPGTQLQQQSTPSQTA

WALMGLLAHLPLTDPAIERGIRWLVCSQQPEKGNGASWPEAVYTGTGFPNHFYLGYDYYRHY

FPMMALGRYLQASQAQA

>seq_ID 94
MNDLTDMATLSAGTVPAELDAAVARATDALLAAQNADGHWVYELEADSTIPAEYVLLVHYLGE

TPNLELEQKIGRYLRRIQQADGGWPLFTDGAPNISASVKAYFALKVIGDDENAEHMQRARRAIH

AMGGAEMSNVFTRIQLALYGAIPWRAVPMMPVEIMLLPQWFPFHLSKVSYWARTVIVPLLVLNA

KRPLAKNPRGVRIDELFIDPPVNAGLLPRQGHQSAGWFAFFRAVDHVLRAVDGLFPAYTRERAI

RQAVAFVDERLNGEDGLGAIYPAMANAVMMYDVLGYAEDHPNRAIARKSIEKLLVVHEDEAYC

QPCLSPVWDTSLAAHALLETRDPRAEQAAVRGLDWLRPLQILDVRGDWISRRPHVRPGGWAF

QYANPHYPDVDDTAVVAMAMDRAQKLNQSDTYRESIARAREWVVGMQSSDGGWGAFEPEN

TQYYLNNIPFSDHGALLDPPTADVSGRCLSMLSQLGETALNSDAARRALDYMLKEQEPDGSW

YGRWGMNYVYGTWTALCALNAAGLGPDDARVKRAAQWLLSIQNKDGGWGEDGDSYKLNYR

GYEPAPSTASQTAWALLGLMAAGEVNNPAVKRGIDYLIAEQKEHGLWDEARFTATGFPRVFYL

RYHGYRKFFPLWALARYRNLKRDNTTRVTVGI

>seq_ID 30
MERSSLLVPASIDSHSRESETTGLDQAIVRARAALLGRQGADGHWCFELESDCTITAEYILMMH

FTDEIDEDLQERMARYLRATQVQETHGGWPQYVGGAIDLSCTVKAYYALKAAGDSPEAPHMR

RAREAVLALGGAAKSNVFTRILLAMFEQVPWRAVPYLPVEIMLLPRWAPIHIEKMSYWARTTLV

PLTILCSLKARAANPKRVDIRELFVTAPEQERHYFLRGGLLNRIFLGLDKFARTLDRWMPKSLRQ

HAIRKAEAWFLPRMNGEDGLGAIFPPMVNCYEAMILLGYPKDHPARKTCLRSIQKLIVHRDDGS

AYCQPCVSPVWDTAWSAMALIHSGDDTATQTAIARAGDWLVQRQELDCRGDWEAQAPQAAP

GGWAFQYANGYYPDIDDTALVAALLHISDRRRGQPGQHAFNIDRAVDWMLALQSRNGGFAAF

DADNTHYYLNAIPFADHGALLDPPTEDVSGRVAACLGILKRDQDRDGLRRCIDYLRTTQQPDG

Enzyme Sequences

SWWGRWGSNYIYGTWSALSGLALAGEDLRQPYLRKSVDWLRTRQHPDGGWGETNDSYIDP

HLAGTNAGISTPHSTAWAVLAQLAMGEVESDSVRRGIAFLLACQQTDGLWSHPSHNAPGFPR

VYYLKYHGYAAYFPLYALARYRHLLNRSREQR

>seq_ID 98
MNDMTEMHTLDATAAPAGLDAAVARATDALLAAQQADGHWVYELEADSTIPAEYVLLVHYLGE

APNVELEQKIARYLRRIQQPDGGWPLFTDGAPNISASVKAYFALKVIGDDENAEHMQRARRAIH

AMGGAEMSNVFTRIQLALYGVVPWYAVPMMPVEIMLLPQWFPFHLSKVSYWARTVIVPLLVLN

AKRPVAKNPRGVRIDELFKGAPVSTGLLPKQPHQSAGWFAFFRAVDGVLRLVDGLFPRYTRER

AIRQAVAFVDERLNGEDGLGAIYPAMANAVMMYAALGYPEDHPNRAIARRSIEKLLVVGEQEAY

CQPCLSPVWDTSLAAHALLETGDARAREAAVRGLDWLVPRQILDVRGDWISRRPHVRPGGWA

FQYANAHYPDVDDTAVVAMAMDRVAKLDRTDAYRESIARAREWVVGMQSSDGGWGAFEPEN

TQYYLNNIPFSDHGALLDPPTADVSGRCLSMLAQFGETSASSEPARRALDYMLKEQEPDGSW

YGRWGMNYIYGTWTALCSLNAAGLGHDDPRVKRAAQWLLSIQNADGGWGEDGDSYKLDYR

GYERAPSTSSQTAWALLGLMAAGAVDNPAVARGVDYLLGTQREHSLWDETRFTATGFPRVFY

LRYHGYRKFFPLWALARYRNLKRANATRVTVGM

>seq_ID 187
MTSDTASAAALDPRRLATSITRASRALHDVQQPDSHWVFELEADVTIPAEYVMMRHYFAEPVD

AEIEAKIAKYLRRMQNDNGGWSLFYGHEFDMSASVKAYYALKMIGDSPDAPHMKKAREAMLA

RGGASRANVFTRIMLALFGQVSWKAVPMMPVEIMLLPRWFPFHLTKVSYWARTVIVPLLVLMT

LKPRAKNPRGIGVRELFLEDPQTVGPTPKAAHQSQLWFTSFDIIDRVLRITDPFFPKGMRKRAIA

KAEAFVTERLNGVDGLGAIFPAMVNSIMMYDVLGYPPNDPNRALARESVERLLVIKDDEAYCQP

CVSPVWDTALAAHSMLESGEAADIEAAKAGLDWLLPRQVLDLKGDWADKRPDVRPGGWAFQ

YNNAHYPDLDDTAVVVMAMDRVRRLDGTTKYDEAIARATEWILGLQSENGGWAAFDADNLEY

YLNNIPFADHGALLDPPTEDVTARCLSMLAQLGDTLETSEPMRRGVEYLRKTQLPDGSWFGR

WGINYVYGTWSVLCALNAVGVPHDDPMIAKAADWLESIQNEDGGWGEDGNSYKLNYKGYER

AATTASQTAWATLALMAAGRVDRDATQRGIDNLVQSQEADGFWGEPYYTGGGFPRVFYLRY

HGYSKFFPLWAMARYRNLRSSNSRFVGAGM

>seq_ID 207
MNKHSGNRTAIDPAALEMSIASATEALLAYRHADGHWAFELEADSTIPSEYILLRHYLAEPIDVVL

EAKIGNYLRRTQGAHGGWPLVHDGPFDMSASVKSYFALKMIGDSVDAAHMVKAREAIRARGG

AANSNVLTRFLLALYGVVSWRAVPVLPIEIVLLPIWSPFHLYKISYWARTTIVPLMVLAVLKPRAK

NPKGVGIEELFLQDTKSVGMNPKAPHQSWGWFLLFRGIDGILRVIEPHLPKKLRERAIASALAFT

EERLNGEDGMGAIYPSMANIVMMYDALGKDDHFPPRAIARRAIDKLLVIGEEEAYCQPCLSPVW

DTALTCHALQEVGGANAVAKAKQGLDWLKPRQVLDVKGDWAVKAPNIRPGGWPFQYNNAHY

PDLDDTAVVVMAMDRAQRHAGSKEYATAIARGREWIEGMQSRDGGWAAFDVNNLEYYLNNL

PFADHGALLDPPTEDVTARCVSMLAQVGEFTQRSKAVAEGIAYLRRTQHAEGSWYGRWGLNY

IYGTWSVLCALNAAGIDHQDPMIRKAVEWLVSIQSWDGGWGEDAISYRLDYSGYEQAPSTSSQ

TAWALLGLMAAGEVEHPAVARGVNYLKNAQTENGLWDEQRYTATGFPRVFYLRYHGYSKFFP

LWALARYRNLRSTNV

-continued

Enzyme Sequences

>seq_ID 29
MTTGHRQFDDGLSERERLIHEAGLTLQRSMDYAYNVVRSDGHWCGEMSSNVTITAEYIFLRQA

LGLDLKTDGAAYCRHILSQQNSDGSWGLAPEYPGDVSTTTEAYLALKMLGLSTDAPAMQQAK

AFVLNAGGVAKVRVFTRIFLATFGLFPWKAVPQLPVELILLPSACPINIYKFASWARGTIAPLLIIC

HHQPVYALPNGVFAENEYLDELWQDSTNKSEPYSPSIWELLSQGDITGLTFSLLDKLLYQLNGL

RSIPLLRSYALKQCMKWILERQEPTGDWAGIFPPMHASVYAFVLEGYKLEDPPVRLGIEALENF

AWEDAKGKRVQPCVSPVWDTTLMSIALSDAATPNHQIVDRAIQWIRDRQLLEPRGDWRVYRP

RLAPGGFSFEYTNSHYPDIDDSAAIILAQVKHDPISANSSSVIAAATWILGMQNPDGGWAAFDV

ENDKLFLNKIPFSDMDSLCDTSCADITGRILEAFGLLIRRVPDKDSSQLFQLLPAIRAACRRGIRY

LASTQEANGAWFGRWGCNYIYGTSHALCGLAYFLQEDQQVPAMVQPALQWLKSQQNDDGG

WGESLLSYQSPERKEQRSTASQTAWALMGLLAHLPHTDIVIERGIRWLVSSQRPVETLGSTWP

EPVYTGTGFPNHFYLGYDYYRHYFPMMALGRYLRGVQG

>seq_ID 25
MLQTEAITTEGLRVRSLSPDDPLLPRIKQAIKLSGQHSRGEMHSDGHWCGEVKTNATTSAEHV

LLCQALGINLDADREAFISWFRCTQGADGGWSTAPDQAGDISVTVEAYLALKILGLSEDDAAMR

RARDFAIAAGGVAKVRIFTRIYLALFGLFPWAAVPELPPELILLPSRVPVSIYHWSAWARATVVPL

LIISHHRPIYALPGGGKGTSSDYLDELWCDPQNKMIPYNHDEPTAWRSDPFASIFTLADSILHRL

DGLRSFNPFRRFALQKCVDWILEHQEDMGDIGDIMPPLHGAMLALRLEGYPLHSGPIHRGLEAI

ERFAYRDKQGKRIQTTVSAFWDTSLMLIALGDAGMASKPWLTRSLGWLQQHQRLGNYGDWK

VNNHGLKAGGFSFGYFNTWYPDVDDTASAVLAMIRQDERLVHSASVLDALNWLLGMQNTDG

GWGAFDRDNDKHFLNKIPFSDMDALCDPSTPDVTGHVLEAFGLFLALSKADALADRVVAASRR

AIRYLSDTHVLSRGWYGRWGCNYIYGTSAVLCALAYFGSENDALSGVRVMKDAINQAIRWLET

VQNPDGGWGETVDSYKDPSRAGSGPSTASQTAWAIMALLPYLPPSTEVIQRGMEYLLRTQTK

TASQGATWHEKAYTATGFPKYFYMGYSLYAHYFPMMALGRYAYPCPAWHENWRLKRD

>seq_ID 97
MNDLSQAQPLDAILPDFADAAPSAPAPAVTGEAPTASLDAAITRATEAILAAQKPDGHWVYELE

ADATIPAEYVLLVHYLGETPNLELEQKIARYLRRIQLPDGGWPLFTDGALDISASVKAYFALKMIG

DPADAEHMVRAREAILAHGGAETVNVFTRILLALFGVVSWRAVPMMPVEIMLLPMWFPFHLSK

VSYWARTVIVPLLVLNAKRPVARNPRRVRIDELFRGAPVNTGPRDRAPHQHAGWFRFFSGVD

VLLRAVDGLFPKSTRERAVRQAVAFVDERLNGEDGLGAIFPAMANSVMMYDVLGYPADHPNR

AIARQSIDKLLVIKDDEAYCQPCLSPVWDTSLAAHALLETGEAHAEQAAERGLAWLRPLQILDVR

GDWISRRPNVRPGGWAFQYNNAHYPDVDDTAVVAMAMQRSATVTQSDVDRDAIARAREWVV

GMQSSDGGWGAFEPENTQYYLNNIPFSDHGALLDPPTADVSGRCLSMLAQLGELPQNSEPAQ

RAFDYMLKEQESDGSWYGRWGLNYIYGTWTALCSLNAAGLPHDDPRMKRAAQWLLSIQNED

GGWGEGGESYKLDYHGYERAPSTASQTAWALMGLMAAGEVNHEAVARGVAYLEREQREHG

LWDETRFTATGFPRVFYLRYHGYRKFFPLWALARFRHLKRNGLTRVAVGM

>seq_ID 176
MNSVNATVAPIDDAALGGSIGAATRGLLDLKQPDGHFVFELEADATIPSEYVLLRHYLGEPVDA

ALEAKIAVYLRRIQGAHGGWPLVHDGPFDMSASVKAYFALKMIGDSIDAPHMARAREAILSRGG

AANVNVFTRFLLSLFEVLTWRSAPVLPIEIMLLPMWSPFHINKISYWARTTMVPLMVLAALKPRA

RNPRGIGIRELFLQDPATVGTPKRAPHQSPAWFTLFNSLDWILRKIEPLFPKRLRARAIEKAIAFV

| Enzyme Sequences |
| --- |
| EERLNGEDGLGAIFPPMVNTVMMYDALGFPPEHPPRAVARRGIDKLLVIGKDEAYCQPCVSPI |
| WDTALTCHALLEAGGPEALSGAGKSLDWLLPKQELVLKGDWAVKRPDVRPGGWAFQYANAH |
| YPDLDDTAVVVMAMDRVRRNDRSDKYNEAIARGREWIEGMQSRDGGFAAFDADNLEYYLNNI |
| PFSDHAALLDPPTEDVTARCVSMLAQLGETVRSSPSMAAGVDYLRRTQLKEGSWYGRWGLN |
| YIYGTWSVVCALNAAGVDHQDPAMRKAVDWLVSIQNADGGWGEDAVSYRLDYKGFEGAPTT |
| ASQTAWALLALMAAGEVENPAVARGMKYLIDTQTKKGLWDEQRFTATGFPRVFYLRYHGYSR |
| FFPLWALARYRNLRSTNSKVVGVGM |
| >seq_ID 210 |
| MDSGTFNPGGERGNTLDASIDAARAALLGYRRDDGHWVFELEADCTIPAEYVLLRHYLGEPID |
| AALEAKIAVYLRRTQGAHGGWPLVYDGEFDMSATVKGYFALKMIGDSIDAPHMAKAREAILSR |
| GGAVHANVFTRFLLAMFGILTWRAVPVLPVEIMLLPMWSPFHLNKISYWARTTIVPLMVLAALKP |
| RAVNRLGVGLDELFLQDPKSIGMPARGPHQNRGLFALFGAIDAVLRVIEPLIPKKLRKHAIDRAV |
| AFVEERLNGEDGLGAIYPPMANTVMMYKVLGYPEDHPPRAITRRGIDLLLVIGEEEAYCQPCVS |
| PIWDTSLTCHALLEAGGAEAAQPVREGLDWLLPKQVLDLKGDWAVKAPNVRPGGWAFQYNN |
| AHYPDLDDTAVVVMALDRARRDQPSAAYDNAIARGREWIEGMQSDDGGWAAFDVNNTEYYL |
| NNIPFSDHGAMLDPPTEDVTARCVSMLAQLGETEQTSKAVARGVAYLRKTQLPDGSWYGRW |
| GMNYIYGTWAVLCALNAAGVDHQDPAIRKAVAWLASIQNADGGWGEDGVSYRLDYRGYETAP |
| STASQTAWALLSIMAAGEVDHPAVARGIEYLKGTQTEKGLWDEQRHTATGFPRVFYLRYHGYS |
| KFFPLWGLARYRNLRATNSKVVGVGM |
| >seq_ID 23 |
| MTTGHRQFDDGLSERERLIHEAGLTLQRSMDYAYNVVRSDGHWCGEMSSNVTITAEYIFLRQA |
| LGLDLKTDGAAYCRHILSQQNSDGSWGLAPEYPGDVSTTTEAYLALKMLGLSTDAPAMQQAK |
| AFVLNAGGVAKVRVFTRIFLATFGLFPWKAVPQLPVELILLPSACPINIYKFASWARGTIAPLLIIC |
| HHQPVYALPNGVFAENEYLDELWQDPTNKSEPYSPSIWELLSQGDITGLTFSLLDKLLYQLNGL |
| RSIPLLRSYALKQCMKWILERQEPTGDWAGIFPPMHASVYAFVLEGYKLEDPPVRLGIEALENF |
| AWEDAKGKRVQPCVSPVWDTTLMSIALSDAATPNHQIVDRAIQWIRDRQLLEPRGDWRVYRP |
| RLAPGGFSFEYTNSHYPDIDDSAAIILAQVKHDPISANSSSVIAAATWILGMQNPDGGWAAFDV |
| ENDKLFLNKIPFSDMDSLCDTSCADITGRILEAFGLLIRRVPDKDSSQLFQLLPAIRAACRRGIRY |
| LASTQEANGAWFGRWGCNYIYGTSHALCGLAYFLQEDQQVPAMVQPALQWLKSQQNDDGG |
| WGESLLSYQSPERKEQRSTASQTAWALMGLLAHLPHTDIVIERGIRWLVSSQRPVETLGSTWP |
| EPVYTGTGFPNHFYLGYDYYRHYFPMMALGRYLRGVQG |
| >seq_ID 91 |
| MNDLSQAHVLGAAMPETAGEAQNAQAAANSAAAAAEASAVLAPSLDAAITRATDAILAAQKPD |
| GHWVYELEADATIPAEYVLLVHYLGETPNVELEQKIARYLRRIQLPNGGWPLFTDGAIDISASVK |
| AYFALKMIGDPVDAEHMVRAREAILAHGGAETVNVFTRILLALFGVVSWRAVPMMPVEITLLPM |
| WFPFHLSKVSYWARTVIVPLLVLNAKRPLARNPRRVRIDELFRGAPVNTGMPARAPHQHVGWF |
| GFFRVVDTVLRAVDGLFPKATRERAVREAVAFVDQRLNGEDGLGAIFPAMANSVMMYDVLGY |
| PADHPNRAIARRSIEKLLVIKDDEAYCQPCLSPVWDTSLAAHALLETGDARAEQAAERGLAWLR |
| PLQILDVRGDWISRRPNVRPGGWAFQYNNAYYPDVDDTAVVAMAMHRSEALTHSGADREAIA |
| RAREWVVGMQSDDGGWGAFEPENTQYYLNNIPFSDHGALLDPPTADVSGRCLSMLAQLGEF |

Enzyme Sequences

PQNSEPAQRALDYMLKEQEADGSWYGRWGLNYIYGTWTALCSLNAAGLPHDDPRIRRAAQW

LLSIQNEDGGWGEGGESYKLDYRGYERAPSTASQTAWALMGLMAAGEVDHEAVARGIEYLQR

EQREHGLWDETRFTATGFPRVFYLRYHGYRKFFPLWALARYRHLKRNGLTRVAVGM

>seq_ID 213
MDSGSYTTGVERNALEASIDAARSALLNYRRDDGHWVFELEADCTIPAEYVLLRHYLGEPVDA

ELEAKIAVYLRRIQGAHGGWPLVHDGDFDMSASVKGYFALKMIGDSIDAPHMVRAREAIRSRG

GAIHSNVFTRFLLTLYGVTTWRAVPVLPVEIMLLPSWSPFTLTKISYWARTTMVPLLVLCALKPQ

AKNPKGVGIDELFLQDPKTIGMPVKAPHQNWALFKLFGSIDAVLRVIEPVMPKGIRKRAIDKALA

FIEERLNGEDGMGAIFPPMANAVMMYEALGYPEDYPPRASQRRGIDLLLVDRGDEAYCQPCVS

PVWDTALASHAVLEADGHEGAKSVRPALDWLLPRQVLDVKGDWAVKAPNVRPGGWAFQYNN

AHYPDLDDTAVVVMALDRARKDQPNPAYDAAIARAREWIEGMQSDDGGWGAFDINNTEYYLN

NIPFSDHGAMLDPPTEDVTARCVSMLAQLGETMDSSPALARAVGYLRDTQLAEGSWYGRWG

MNYIYGTWSVLCALNAAGVPHADPMIRKAVAWLESVQNRDGGWGEDAVSYRLDYRGYESAP

STASQTAWALLALMAAGEVDHPAVARGIEYLKSTQTEKGLWDEQRYTATGFPRVFYLRYHGY

SKFFPLWALARYRNLQATNSKVVGVGM

>seq_ID 196
MSMTSREDHDASSLISQVEHALKLSNDYALGLVHPDGHWYGEMNTNVTVTAEYVFLRQALRL

DLKTDIAAYCHYLLSQQNSDGSWGLAPEYPGDVSTSTEAYLALKILGTSPHTPAMRNARAFVLK

AGGIARVRIFTRIFLATFGLFPWSAVPELPVELMLLPSICPINIYKFASWARGTIAPLLIICHHQPVY

SLPNGKSTDNDYLDELWVDCTNKSVPYGLPLWDLMSQGEFAGLAFGVLDKVLYQLNGLRSIPL

IRAYARKQCIQWILERQEKTGDWAGIFPPMHANMYAFTLEGYKLDDDPVRLGFQALERFAWED

EKGKRIQACVSPVWDTALMTIGLCDAMSPNKQTIDHALAWIRARQLLEPRGDWRVYRPQLAPG

GFSFEYENSWYPDVDDTAAIILAQVKHDNGSIGSNSVIAAATWILGMQNPDGGWAAFDVENDK

LFLNKIPFSDMDSLCDTSCADITGRILEAYGLMMMKYFSAKSDADPLLHTLRAACMRGMHYLAS

TQEPNGSWYGRWGCNYIYGTSHVLCGLAYFVEKRLVCVMVKSALQWLKSRQNDDGGWGES

LLSYQSPDREQQASTPSQTAWALMGLLSHLPVTDDAIERGIRYLVSSQRPEKGIGSSWPQAEY

TGTGFPNHFYLGYDYYRHYFPMMALGRYLQGSRGLN

>seq_ID 99
MNDLSQTQPLAAVLPEAADAPAVADASATAAPEPVQAASPSALDASITRATDTILAAQKPDGH

WVYELEADATIPAEYVLLVHYLGETPNLELEQKIARYLRRIQLPNGGWPLFTDGALDISASVKAY

FALKMIGDPVDAEHMVRARDAILAHGGAERANVFTRILLALFGVVSWRAVPMMPVEIMLLPVWF

PFHLSKVSYWARTVIVPLLVLNAKRPLARNPRKVRIDELFRAAPVNTGMNERAPHQHAGWFGF

FRCVDTVLRAVDGLLPKATRERAIRAAVAFVDERLNGEDGLGAIFPAMANSVMMYDVLGYPAD

HPHRAIARKSLDKLLVIKDDEAYCQPCLSPVWDTSLAAHALLETGEARAEQAAERGLAWLRPL

QILDVRGDWISRRPNVRPGGWAFQYNNAHYPDVDDTAVVAMAMHRSAALTQSDVDREAIARA

REWVVGMQSSDGGWGAFEPENTQYYLNNIPFSDHGALLDPPTADVSGRCLSMFAQIGELPQS

SEPARRAFDYMLQEQEPDGSWYGRWGLNYIYGTWTALSSLNAAGMPHDDPRMRRAAQWLV

SIQNEDGGWGEGGESYKLDYHGYERAPSTASQTAWALLGLMAAGEVNHEAVARGIDYLQRE

QREHGLWDETRFSATGFPRVFYLRYHGYRKFFPLWALARFRHLKRHGLTRVTVGM

| Enzyme Sequences |
| --- |

>seq_ID 85
MIRRMNKSAPSPWSALDAAIARGRDALVRLQQPDGSWCFELESDATITAEYILMMHFMDRIDD

VRQERMARYLRANQRLDTHGAWDLYVDGAPDVSCSVKAYFALKAAGDSEHAPHMIRARDAIL

KLGGAARSNVFTRILLATFGQVPWRAAPFMPIEFVLFPKWVPISMYKVAYWARTTMVPLLVLCS

LKARARNPRNVSIRELFVTPPEQERHYFLPARGMRRLFLALDRTVRPIEPLLPKRLRQRAIRHAE

AWCAERMNGEDGLGGIFPPIVYSYQMMQVLGYPDDHPLRRDCENALEKLLVTRPDGSMYCQ

PCLSPVWDTAWSTMALEQARGVAAPETGDTASGALRELDERIARAYDWLATRQVNDLRGDWI

ENAPADVEPGGWAFQYANPYYPDIDDTALVTAMLDRRGRTHRGADGTHPYASRVARALDWM

RGLQSRNGGFAAFDADCDRMYLNAIPFADHGALLDPPTEDVSGRVLLCFGVTKRAADRASLAH

AIDYVKRTQQPDGSWWGRWGTNYLYGTWSVLAGLALAGEDKSQPYITRALDWLRARQHADG

GWGETNDSYIDPKLAGTNDGESTSNCTAWALLAQMAFGDCESDSVKRGIAYLQSVQQEDGF

WWHRSHNAPGFPRIFYLKYHGYTAYFPLWALARYRRLAGAKDADATRSPASATPATDNALA

>seq_ID 93
MIRAMNKSALSPWSALDTAIARGRDALARLQQPDGSWCFELESDATITAEYILMMHFMDRIDDA

LQERMARYLRAIQRLDTHGAWDLYVDGAPDVSCSVKAYFALKAAGDSEHAPHMIRAREAILKL

GGAARSNVFTRILLATFGQVPWRATPFMPIEFVLFPKWVPISMYKVAYWARTTMVPLLVLCSLK

ARARNPRNVAIPELFVTPPDQERHYFPPTRGMRRAFLILDRVVRHVEPLLPKRLRRRAIRHAEA

WCAQRMNGEDGLGGIFPPIVYSYQMMDVLGYPEDHPLRRDCENALAKLLVTRPDGSVYCQPC

LSPVWDTAWSTMALEQARSVAVPESDESARALDELDARIARAYDWLATRQVNDLRGDWIENA

PADTQPGGWAFQYANPYYPDIDDSAVVTAMLDRRGRTHRNADGSHPYAARVARALDWMRAL

QSRNGGFAAFDADCDRLYLNAIPFADHGALLDPPTEDVSGRVLLCFGVTRRAEDRASLARAID

YVKRTQQPDGSWWGRWGTNYLYGTWSVLAGLTLAGEDPSQPYIARALEWLRAHQHADGGW

GETNDSYLDPALAGTNGGESTSNCTAWALLAQMAFGDCASDSVKRGIAYLQSVQQDDGFWW

HRSHNAPGFPRIFYLKYHGYTAYFPLWALARYRRLAGAAEARARASSGRAPHAADTALA

>seq_ID 168
MGKVETLHRMSTQDITLDDVERRVSLASKALMRLAGPDGHWCFELEADATIPSEYILYHHFRG

SIPSAELEGKIANYLRRTQSAQHDGWSLVHDGPFDMSATVKAYFALKMIGDSIEAPHMRRARE

AILRRGGAAHANVFTRTLLALYGEVPWSAVPVMPVEVMLLPRWFPFHLDKVSYWARTVMVPLF

VLQAKKPRARNPRGIGIQELFVEPPERVKRWPAGPQESSPWRPVFAAIDKVLQKVEGSFPAGS

RARAIDKAVAFVSERLNGEDGLGAIFPAMVNAVLMYEALGYPEDHPLVATARSSVEKLVTVKEH

EAYVQPCLSPVWDTALSAHALMEAGGVEAERHAKRALDWLKPLQVLDIKGDWAASKPNVRPG

GWAFQYANPHYPDLDDTAVVVMAMDRAQVRRSPGPDAADYGQSIARAREWVEGLQSRDGG

WAAFDADNTYHYLNYIPFSDHGALLDPPTADVTARCVSMLAQLGETRESCPPLDRGVAYLLAD

QEADGSWYGRWGMNYIYGTWSVLCALNAAGVDPASEPVRRAVNWLTTIQNPDGGWGEDAA

SYKLEYRGYERAPSTASQTAWALLGLMAAGEADSPAVARGINYLTRSQGADGLWTEDRYTAT

GFPRVFYLRYHGYAKFFPLWALARYRNLQQSNSRRVAVGM

>seq_ID 184
MKKFGGMARTSLQAQSPGSNNTPSMDEKMLKAGLEAARGALLAQQREDGHWCFPLEADCTI

PAEYILMMHFMDEVDLDLEVRIARFIREKQDVAHGGWPLYYGGEFDLSCSVKAYYALKIVGDSP

DAPHMVRARAAILKHGGAARANVFTRLLLAMYDQLPWRGVPFVPVEIILFPKWFPFHTSKVAY

WSRTVMVPLSILCSLKARAANPRKVAIRELFTVPPGEERNYFPVRTALNRVFLLIERTLSLLEPFI

Enzyme Sequences

PQGVRRLALRRAESWIVERLNGDSGLGAIFPAMVNAGEALALLGYPYDHPAREQCRKALRLLL

VEEGERTWCQPCVSPVWDTVLTCLAFQEDTEVDQKPIRKALDWLVPCQVLDAPADWQEDHP

GLPGGGWAFQYANPHYPDLDDTAAVAWALYQADPKAYQESISRAADWLAGMQSSNGGFAAF

DSDNTYYYLNEIPFADHGALLDPPTSDVSARCAGFLALYGQSRHKQALERSLAYLFNEQEASG

AWFGRWGSNYIYGTWSVLEAFRLAGIDAGHPAIRRAVHWLKSVQREDGGWGESNDSYLSPQ

QAGQFHTSTSFHTAWALLALMGAGEWRSHEVHRGIAYLLREQDSDGLWHEPWFTAPGFPRV

FYLKYYGYTKYFPVWALTRFHALNRKFPG

>seq_ID 12
MMYNNQWYFNQFNDIFCFPEQQKEYFPPTGTNISLNLKKRPDRQLLAHGASDLNGPFHLSQH

NAFSAMLLAEVQKVLRLAVGHSLDLQRTDGAWCGEVHSNATFTAQYVFLQQQLGLPLDPTEIE

GLSRWLFSQQNEDGSWGLGPGLGGDVSTTTETYLALKILGVSPEDPRMAAARSSIIKAGSLPA

TRMFTRVFLASFGLIPWSAVPPLPAELILLPTLFPVNIYNLSSWARATCVPLLLIRHHEPLHSLPN

GRHAENDFLDELWTKDIPRDFCYTTPLSRMWRLGDYAGIFFTSADHGLRFLGQYFNSPLRNLS

RRKIINWILDHQEQSGEWAGYWPPQHNNIWALSLEGYSLDHPVLRRGIAAVKSFVLHDVTGMR

AQVTVSQVWDTALMSIALSDSAPSTGIISPTQAIDWLMHHEVASHRGDWRVLRPKLATGGFCF

EEFNTLYPDVDDTAAVIMALIKSNPAHLISGCVRRAAQWILGMQNRDGGWGAFDWNNDKFFLN

KIPFSDMDSLCDPSTPDVTGRIIECFGMMMAGRHGYSLDGPLESRLRASSQLAIAYLLGCQENN

GSWWGRWGVNYLYGTSNVLCGLAYYYDRSGLSKGDGKSNSHIVSAVDRASEWLKARQHSN

GGWGEGPESYDSAQLAGCGQPTASQSAWVTMALLNYLSPTDEVIQRGISYLVRSQVKYGDES

RATWPLERYTATGFPGHLYMEYDYYRHYFPIMALGRYVNKLSESHKLL

>seq_ID 100
MIRRMTTPTPSPWSALDTAIARGRDALVRLQQPDGSWCFELESDATITAEYILMMHFMDKIDDL

RQEKMARYLRANQRLDTHGGWALYVDGDPDVSCSVKAYFALKAAGDSEHAPHMVRARDAILK

LGGAARANVFTRILLATFGQVPWRAAPFMPIEFVLFPKWVPISMYKVAYWARTTMVPLLVLCSL

KARARNPRNISIRELFVTPPDEERQYFPPARGMRKLFLALDRTVRHVEPLMPKGLRQRAIRHAE

AWCAERMNGEDGLGGIFPPIVYCYQMMEVLGYPDDHPLRRDCENALEKLLVTRPDGSMYCQP

CLSPVWDTAWSTMALEQARGVAVAEDGEPGDARRALDERITRAYDWLAERQVNDLRGDWIE

NAPADVQPGGWAFQYANPYYPDIDDTAVVTAMLDRRGRTHANADGTNPYATRVARALDWMR

GLQSRNGGFGAFDADCDRLYLNAIPFADHGALLDPPTEDVSGRVLLCFGVTKRADEHASLARC

IDYVKRTQQPDGSWWGRWGTNYIYGTWSVLAGLALAGEDKSQPYIARAIEWLRARQHADGG

WGETNDSYIDPKLGGTNGGESTSNFTAWALLAQMAFGDCESDSVKRGIAYLQSVQQEDGFW

WHRSHNAPGFPRIFYLKYFIGYTAYFPLWALARYRRLAGVANKRVSTADKTADAMA

>seq_ID 84
MIRRMNQSAPSSWSALDAAIARGRDALVRLQQPDGSWCFELESDATITAEYILMMHFMDRIDD

VRQEKMARYLRANQRLDTHGAWDLYVDGAPDVSCSVKAYFALKAAGDSEHAPHMIRARDAIL

KLGGAARSNVFTRILLATFGQVPWRAAPFMAVEFVLFPKWVPISMYKVAYWARTTMVPLLVLC

SLKARARNPRNVSIRELFVTPPEQERHYFPPARGMRRLFLALDRTVRPIEPLLPKRLRQRAIRH

AEAWCAERMNGEDGLGGIFPPIVYSYQMMQVLGYPDDHPLRRDCENALEKLLVTRPDGSMYC

QPCLSPVWDTAWSTMALEQARGVAAPETGDTATGAPRDLDGRIARAYDWLATRQVNDLRGD

WIENAPADVEPGGWAFQYANPYYPDIDDTALVTAMLDRRGRTHRAADGTHPYASCVSRALDW

Enzyme Sequences

MRGLQSRNGGFAAFDADCDRMYLNAIPFADHGALLDPPTEDVSGRVLLCFGVTKRAADRASL
ARAIDYVKRTQQPDGSWWGRWGTNYLYGTWSVLAGLALAGEDKSQPYIARALDWLRARQHA
DGGWGETNDSYLDPKLAGTNGGESTSNCTAWALLAQMAFGDCESDSVKRGIAYLQSVQQED
GFWWHRSHNAPGFPRIFYLKYHGYTAYFPLWALARYRRLAGAKDAGATRSGASGASATSVTD
DALA

>seq_ID 86
MIRRMNKSAPSPWSTLDTAIARGRDALVRLQQPDGSWCFELESDATITAEYILMMHFMDRIDD
VRQEKMARYLRANQRLDTHGAWDLYVDGAPDVSCSVKAYFALKAAGDSEQAPHMIRARDAIL
KLGGAARSNVFTRILLATFGQVPWRAAPFMPIEFVLFPKWVPISMYKVAYWARTTMVPLLVLCS
LKARARNPRNVSIRELFVTPPEQERRYFPPARGMRRLFLALDRAVRHIEPLMPKRLRQRAIRHA
QAWCAERMNGEDGLGGIFPPIVYSYQMMQVLGYPDDHPLRRDCENALEKLLVTRPDGSVYCQ
PCLSPVWDTAWSTMALEQARGVAAPETGETAAGTLRELDERIARAYDWLAARQVNDLRGDWI
ENVPADVEPGGWAFQYANPYYPDIDDSALVTAMLDRRGRTHRHADGTNPYAPRVARALDWM
RGLQSRNGGFAAFDADCDRMYLNAIPFADHGALLDPPTEDVSGRVLLCFGVTKRAEDRASLAR
CIDYVKRTQQPDGSWWGRWGTNYLYGTWSVLAGLALAGEDKSQPYIARALDWLRARQHADG
GWGETNDSYLDPTLAGTNGGESTSNCTAWALLAQMAFGDCESDSVKRGIAYLQSVQQEDGF
WWHRSHNAPGFPRIFYLKYHGYTAYFPLWALARYRRLAGAAAAPPAALVAADTALA >seq_ID 80
MIRRMNKPAPSPWSALDTAIARGRDALMRLQQPDGSWCFELESDATITAEYILMMHFMDKIDD
ARQEKMARYLRAIQRLDTHGGWDLYLDGDPDLSCSVKAYFALKAAGDSEHAPHMVRARDAIL
KLGGAARSNVFTRILLATFGQVPWRATPFMPIEFVLFPKWVPISMYKVAYWARTTMVPLLVLCS
LKARARNPRNIAIPELFVTPPDQERQYFPPARGMRRAFLALDRVVRHVEPLLPKRLRQRAIRHA
QAWCAERMNGEDGLGGIFPPIVYSYQMMDVLGYPDDHPLRRDCENALEKLLVTRPDGSMYC
QPCLSPVWDTAWSTMALEQARGVAVPEAGAPAGALDELDARIARAYDWLAERQVNDLRGDW
IENAPADTQPGGWAFQYANPYYPDIDDSAVITAMLDRRGRTHRNADGSHPYAARVARALDWM
RGLQSRNGGFAAFDADCDRMYLNAIPFADHGALLDPPTEDVSGRVLLCFGVTKRADDRASLA
RAIDYVKRTQQPDGSWWGRWGTNYLYGTWSVLAGLALAGEDPSQPYIARALAWLRARQHAD
GGWGETNDSYIDPALAGTNAGESTSNCTAWALLAQMAFGDGESESVKRGIAYLQSVQQDDGF
WWHRSHNAPGFPRIFYLKYHGYTAYFPLWALARYRRLAGGASSAGAHTVPASTGADAALA >seq_ID 82
MNKPAPSPWSALDTAIARGRDALMRLQQPDGSWCFELESDATITAEYILMMHFMDKIDDVRQE
KMARYLRAIQRLDTHGGWDLYVDGDPDVSCSVKAYFALKAAGDSEHAPHMVRARDAILALGG
AARSNVFTRILLATFGQVPWRATPFMPIEFVLFPKWVPISMYKVAYWARTTMVPLLVLCSLKAR
ARNPRNIAIPELFVTPPDEERHYFPPARGMRRAFLALDRVVRHVEPLLPKRLRQRAIRHAQAWC
AERMNGEDGLGGIFPPIVYSYQMMDVLGYPDDHPRRDCENALEKLLVTRTDGSMYCQPCLS
PVWDTAWSTMALEQARAVAVPEAGARASALDELDARIARAYDWLAERQVNDLRGDWIENAPA
DTQPGGWAFQYANPYYPDIDDTAVVTAMLDRRGRTHRNADGSHPYAARVARALDWMRGLQS
RNGGFAAFDADCDRMYLNAIPFADHGALLDPPTEDVSGRVLLCFGVTKRAADRASLARAIDYV
KRTQQPDGSWWGRWGTNYLYGTWSVLAGLALAGEDPSQPYIARALAWLRARQHADGGWGE

Enzyme Sequences

TNDSYIDPTLAGTNAGESTSNCTAWALLAQMAFGDCESESVRRGIAYLQSVQQDDGFWWHRS

HNAPGFPRIFYLKYHGYTAYFPLWALARYRRLASGVSSAGVHAVPASTGADAALA

>seq_ID 108
MNDLSQTQPRDAVLPEAAGAVPPASAPAPAAASEAPAASLDTAITRATDAILAAQKPDGHWVY

ELEADATIPAEYVLLVHYLGETPNVELEQKIARYLRRIQLPDGGWPLFTDGAPDVSASVKAYFAL

KMIGDPADAEHMVRAREAILANGGAEAVNVFTRILLALFGVVSWRAVPMMPVEIMLLPMWFPF

HLSKVSYWARTVIVPLLVLNAKRPLARNPRRVRIDELFRGAPVNTGPRDRAPHQHAGWFRFFS

GVDMLLRAVDGLFPKATRERAVRAAVAFVDERLNGEDGLGAIFPAMANSVMMYDVLGYPADH

PNRAIARQSIEKLLVIKDDEAYCQPCLSPVWDTSLVAHALLETGEARAEQAAERGLAWLRPLQIL

DVRGDWISRRPNVRPGGWAFQYNNDYYPDVDDTAVVVMAMHRSAALTHSEVDREAIARARE

WVVGMQSSDGGWGAFEPENTQYYLNNIPFSDHGALLDPPTADVSGRCLSMLAQLGELPQGS

EPAQRAFAYMLKEQEPDGSWYGRWGLNYIYGTWTALCSLNAAGMPHDDPRMKRAAKWLLSI

QNEDGGWGEGGESYKLDYHGYERAPSTASQTAWALMGLMAAGEVNHEAVARGVAYLQREQ

REHGLWDETRFTATGFPRVFYLRYHGYRKFFPLWALARFRHLKRHGLTRVAVGM

>seq_ID 169
MREAAVSKVETLQRPKTRDVSLDDVERGVQNAARALTEMTQTDGHICFELEADATIPSEYILFH

QFRGTVPRDGLEAKIGNYLRRTQSKVHGGWALVHDGPFDMSATVKAYFALKMIGDDIEAPHM

RAARKAILQRGGAANANVFTRILLALYGEVPWAAVPVMPVEVMHLPKWFPFHLDKVSYWARCT

MVPLEVIQAKKPRAKNPRGIGVAELFVTPPDSVRTWPGSPHATWPWTPIFGAIDRVLQKTQDH

FPKVPRQRAIDKAVAWVSERLNGEDGLGAIFPSMVNSVLMYEVLGYPPDHPQVKIALEAIEKLV

AEKDDEAYVQPCLSPVWDTALTSHAMLETGGAAAEANARAGLDWLKPLQILDIKGDWAETKPN

VRPGGWAFQYANPHYPDLDDTAVVVMAMDRAQRQHGLVSGMPDYSASIARAREWVEGLQS

ADGGWAAFDADNNHHYLNHIPFSDHGALLDPPTADVTARVVSMLSQLGETRETSRALDRGVT

YLLNDQEKDGSWYGRWGMNFIYGTWSVLCALNAAGVDPQSPEIRKAVAWLIRIQNPDGGWG

EDASSYKLNPEFEPGYSTASQTAWALLALMAVGEVDDPAVARGVNYLMRTQGQDGLWNEER

YTATGFPRVFYLRYHGYPKFFPLWAMARFRNLKKGNSRQVQFGM

>seq_ID 163
MREAAVSKVETLQRPKTRDVSLDDVERGVQSAARALTDMTQADGHICFELEADATIPSEYILFH

HFRGTEPRAGLEAKIGNYLRRTQSKVHGGWALVHDGPFDMSASVKAYFALKMIGDDIEAPHM

RAVRKAILQRGGAANANVFTRILLALYGEVPWTAVPVMPVEVMHLPKWFPFHLDKVSYWARCT

MVPLEVIQAKKPRAKNPRGVGVAELFVTPPDSVRTWPGSPHATWPWTPIFGAIDRVLQKTQDH

FPKVPRQRAIDKAVAWVSERLNGEDGLGAIFPSMVNSVLMYEVLGYPPDHPQVKIALEAIEKLV

AEKDDEAYVQPCLSPVWDTALTSHAMLEVGGTQAEANARAGLDWLKPLQILDIKGDWAETKP

NVRPGGWAFQYANPHYPDLDDTAVVVMAMDRAQRQHGLVSGMPDYSTSIARAREWVEGLQ

SADGGWAAFDADNNHHYLNHIPFSDHGALLDPPTADVTARVVSMLAQLGETRETSRALDRGV

TYLLNDQEKDGSWYGRWGMNFIYGTWSVLCALNAAGVDPQSPEIRKAVAWLIRIQNPDGGWG

EDASSYKLNPEFEPGYSTASQTAWALLALMAVGEVDDPAVARGVNYLMRTQGADGLWNEER

YTATGFPRVFYLRYHGYPKFFPLWAMARFRNLKRGNSRQVQFGM

>seq_ID 105
MKPNHTFSPAALDAAILRGRDTLSGLQQPDGSWCFELESDATITAEYILMMHFMDKIDEVRQAQ

MARYLRAIQRVETHGAWDLYVDGAPDISCSVKAYFALKAAGDSEHAPHMIRAREAILKLGGAAR

| Enzyme Sequences |
| --- |
| SNVFTRILLATFGQVPWRAAPFMPVEFVLFPKWVPISMYKVAYWARTTMVPLLVLCSLRARAR |
| NPRNVSIAELFVTPPDEERHYFPPAKGMRKLFLALDRTVRHLEPLLPRRLRQRAIRHAEAWCAE |
| RMNGEDGLGGIFPPIVYSYQMMEVLGYPEDHPLRRDCEDALEKLLVTRADGSVYCQPCLSPV |
| WDTAWSTMALEQARGATPAAPDTQVSERELDARIARAYDWLATRQVNDLEGDWRENARPGT |
| LPGGWAFQYANPYYPDIDDSAVVTAMLDRRGRAQARASGENPYAERVTRALDWMRGLQSRN |
| GGFGAFDADCDRLYLNAIPFADHGALLDPPTEDVSGRVLLCFGVTKRPADRAAAARAIEYVKRT |
| QQPDGSWWGRWGTNYLYGTWSVLAGLALSGEDKSQPYIARALDWLRAHQHADGGWGETN |
| DSYADPRLRATNYGESTSNCTAWALLAQMAFGDWQSDSVRRGIAYLLSVQQDDGFWWHRSH |
| NAPGFPRIFYLKYHGYTAYFPLWALARYRRLAGAQAAPSSPGPGTAATIADPAVA |
| >seq_ID 211 |
| MTSGTTILGAERGRTLDASIDAARAALLGYRRDDGHWVFELEADCTIPAEYVLLRHYLGEPVDA |
| ALEAKIAVYLRRTQGAHGGWPLVHDGEFDVSATVKAYFALKMIGDSIDAPHMAKAREAILARGG |
| AIHVNVFTRFLLSMFGILTWRSVPVLPVEIMLLPMWAPFHLNKISYWARTTIVPLMVLAALKPRA |
| VNKLDIGLDELFLQDPQSIGMPAKAPHQSWGLFTLFGSIDAVLRVIEPLIPKKLRSYAIGRAVAFIE |
| ERLNGEDGLGAIYPPMANTVMMYKVLGYGEDHPPRAITRRGIDLLLVVGEEEAYCQPCVSPIW |
| DTSLTCHALLEAGGAEAALPVRKGLDWLIPKQVLDLKGDWAVKAPNVRPGGWAFQYNNAHYP |
| DLDDTAVVVMALDRARRDQPSAAYDNAIARGREWIEGMQSDDGGWAAFDVNNTEYYLNNIPF |
| SDHGALLDPPTEDVTARCVSMLAQLGETAETSSALARGVAYLRKTQLAEGSWYGRWGLNYIY |
| GTWSVLCALNAAGVAHQDPAMRKAVAWLASIQNADGGWGEDAVSYRLDYRGYESAPSTASQ |
| TAWALLALMAAGEVDHPAVARGVEYLKGTQTEKGVWDEQRYTATGFPRVFYLRYHGYSKFFP |
| LWALARYRNLRATNSKVVGVGM |
| >seq_ID 76 |
| MDSVNATAREAKESKISESEILESSIASATQGVLGFQQSDGHWVFELEADCTIPAEYVLLRHYLA |
| EPVDTVLEAKIGNYLRRVQGAHGGWPLVHDGEFDMSASVKAYFALKMIGDSIDAPHMVRAREA |
| IHARGGAIHSNVFTRFMLAMFGIVTWRAVPVLPIEIMLLPFWSPFHINKISYWARTTMVPLMVIAA |
| LKPRAKNPKGVGIDELFLQDPRSIGMTAKAPHQSMAWFLLFRSLDAILRVIEPLFPKSLRKRAID |
| TALAFSEERLNGEDGMGAIYPPMANLVMMYDALGKDENYPPRAVTRRGIDKLLVIGDDEAYCQ |
| PCVSPVWDTTLTAHALLEAGGDKAGPAAKHGLDWLIPKQELEVKGDWAVKRPDVRPGGWAF |
| QYNNAYYPDLDDTAVVVMSMDRMRREHGVTGYDSAIDRGREWIEGMQSDDGGWAAFDVNN |
| LEYYLNNIPFSDHGALLDPPTEDVTARCVSMLAQLGETAKTSKHVADGVAYLRKTQHPEGSWY |
| GRWGMNFIYGTWSVLCALNMAGVRHDDPMIRKAADWLASIQNKDGGWGEDTVSYRLDYKG |
| WEAAPSTASQTAWALLALMAAGEVDHPAVARGVEYLIATQNEKGLWDEQRYTATGFPRVFYL |
| RYHGYSKFFPLWGLARYRNLRNTNSRVVGVGM |
| >seq_ID 179 |
| MEQQPELISGGVGGVAYPWDLGSQAIEEAILAARAALLAHLHPDGYWCFELEADCTIPAEYIMM |
| MHYTGELEAALELKLARYIRECQLQEGGWPLYYGGAMDISCSVKAYFALKLAGDDPEAAHMRR |
| ARKAVLERGGAVNANVFTHIALALFGEIPWRGVPFMPPEILLLPRWFPFHLSKVSYWSRTVMVP |
| LFILAAHKPRARNPRAIHISELFVTDPQLETGYFKARSRLNRLFITLDALGRRIEPFIPRAVRAKAL |
| RRAAEWFITRLNGEHGLGAIFPAMVNSYEALELLGYAADHPLRQQVRKGLRDLVVEQADRAYC |
| QPCLSPIWDTALACLALQEADRGSSSAQVRHALDWLQARQLLDTPGDWSEQHPSLPGGGWP |

Enzyme Sequences

FQFRNDHYPDLDDTAIVAWAMQRASDPERYGAAIRRATVWLLGMQSANGGFAAFDSDNTRYY

LNEIPFADHGALLDPPTSDVTARVVALLGSLDGEVHDRSALNRAVAFLHREQEAEGCWYGRW

GTNYIYGTWSVLTALEQLGYDFNAPWVRKAVIWLKSVQRDDGWGESNDTYLDHRPQDRQA

DESTPFQTAWAVLALIAAGECRSPEVWRGVEYLLRHQRPDGLWYCPWFTAPGFPRVFYLKYH

GYDAYFPLMALARYRNCVLDNDA

>seq_ID 81
MIRRMNKPAPSPWSALDAAIARGRDALMRLQQPDGSWCFELESDATITAEYILMMHFMDKIDD

ARQEKMARYLRAIQRLDTHGGWDLYVDGDPDVSCSVKAYFALKAAGDSEHAPHMVRARDAIL

ALGGAARSNVFTRILLATFGQVPWRAAPFMPIEFVLFPKWVPISMYKVAYWTRTTMVPLLVLCS

LKAHARNPRNIAIPELFVTPPDQERHYFPPARGMRRAFLALDRVVRHAEPLLPKRLRQRAIRHA

QAWCAERMNGEDGLGGIFPPIVYSYQMMDVLGYPADHPLRRDCENALEKLLVTRPDGSMYC

QPCLSPVWDTAWSTMALEQARGVAVHEAGAPASALDELDARIARAYDWLAERQVNDLRGDWI

ENAPADTQPGGWAFQYANPYYPDIDDSAVVTAMLDRRGRTHRNADGTHPYAARVARALDWM

RGLQSRNGGFAAFDADCDRMYLNAIPFADHGALLDPPTEDVSGRVLLCFGVTKRADDRASLA

RAIDYVKRTQQPDGSWWGRWGTNYLYGTWSVLAGLALAGEDPSQPYIARALAWLRARQHAD

GGWGETNDSYIDPALAGTNAGESTSNCTAWALLAQMAFGDGESESVKRGIAYLQSVQQDDGF

WWHRSHNAPGFTRIFYLKYHGYTAYFPLWALARYRRLAGGASSAGAHAVPASTAADAALA

>seq_ID 22
MATLTTMATTATMATTEASQPLEAQARTALTKATSYAWEIISNRHWCGELESNVTVTCEHIFFL

YVLYQHIDPDEGSQYRQWLLSQQNADGSWGIAPNYPGDVSTSAEAYLALRIIGMSPDSPELFQ

ARTFIRAAGGLSKMRMFTRIFFAEFGLVPWTAIPQLPAEFILVPAHFPISIYRLASWARSNVVPLLI

IAHHRPLYPLPNGLHKQNPFLDELWLDPATKPLPYGSLDPTDPLSFVFTILDKALSYLGGLRRCP

TRGYARRRCIQWILQHQEKAGDWAGIIPPMHAGIKALWLEGYKLHDEPIQLGLAAIERFTWTDN

RGKRLQCCISPVWDTVLMIRALQDTPASLGIKSDPRIADALAWTAENQHRGPEGDWRVYQPNI

PVGGWAFEYSNTWYPDIDDTAAAVLAFLTHDPATARSRLVRDAVLWIVGMQNADGGWAAFDH

ENNRLFLNKIPFSDMESLCDPSTPDVTGRTIECLGMLRDLLMLPAEKAGKKGEKYGYPDGERD

AAADSHLLKIINTACARAIPYLIRTQEATGAWYGRWAVNYVYGTCLVLCGLQYFKHDPTFAPEID

TMATRAVKWLRQIQNSDGGWGESVLSYREPWRAGCGPSTPSQTAWALMGLLTVCGGEDRS

VQRGVRHLVDTQDDILSKGEGGAAAWTEREFTSTGFPNHFYISYTLYRVYFPITALGRYLSLVE

GGKKENGGGA

>seq_ID 178
MNSINATAAPIDDNVLGDRIGAATRGLLSLKQSDGHFVFELEADATIPSEYILMRHYLGEPVDTV

LEAKIAAYLRRIQGAHGGWPLVHDGPFDMSASVKAYFALKMAGDSIDAPHMARAREAILSRGG

AANVNVFTRFLLSFFGELTWRSVPVLPVEIMLLPMWSPFHLNKVSYWARTTMVPLMVLAALKP

RARNPRGIGIRELFLEDPATVGTPKRAPHQSPGWFALFTGFDRVLRLIEPLSPKWLRARAMKKA

IAFVEERLNGEDGLGAIFPPMVNTVMMYDALGFPPEHPPRAVTRRGIDKLLVVGENEAYCQPC

VSPIWDTALSCHALLEAGGPEAVNSAGKCLDWLLLKQELVLKGDWAVKRPDVRPGGWAFQYA

NGHYPDLDDTAVVVMAMDRVRRNGPNGRYDEAIARGREWIEGMQSRDGGFAAFDADNLEYY

LNNIPFSDHAALLDPPTEDVTARCVSMLAQLGETVDSSSSMAAGVEYLRRTQLAEGSWYGRW

GLNYIYGTWSVLCALNVAGVDHQDPVIRRAVNWLVSIQNADGGWGEDAVSYRLDYKGFEGAP

| Enzyme Sequences |
| --- |
| TTASQTAWALLALMAAGEVENPAVARGIKYLIDTQTKKGLWDEQRYTATGFPRVFYLRYHGYS |
| KFFPLWALARYRNLRSTNSKAVGVGM |
| |
| >seq_ID 177 |
| MNATVAQIGDAVLEDRIGSATRGLLNLKQSDGHFVFELEADATIPSEYILLRHYLGEPVDTVLEA |
| KIAAYLRRIQGAHGGWPLVHDGPFDMSASVKAYFALKMIGDSVDAPHMARAREAILSRGGAAN |
| VNVFTRFLLSFFEVLTWRSVPVLPVEIMLLPMWSPFHLNKISYWARTTMVPLMVLAVLKPRARN |
| PRDVGIRELFLQDPATVRTPKRAPHQSPAWFALFSSLDWILRRIEPLFPKRLRARAMEKAIAFVE |
| ERLNGEDGLGAIFPPMVNTVMMYDALGFPPEHPPRAVTRRGIDKLLVIGEDEAYCQPCVSPIW |
| DTALSCHALLEAGAPEALNSAGKCLDWLLPKQELVLKGDWAAKRPDVRPGGWAFQYANGHY |
| PDLDDTAVVVMAMDRVRRNGRGDKYDEAIERGREWIEGMQSRDGGFAAFDADNLEYYLNNIP |
| FSDHAALLDPPTEDVTARCVSMLAQLGATVDGSSSMAAGVEYLRRTQLAEGSWYGRWGLNYI |
| YGTWSVLCALNAAGVDHQDPAIRKAVDWLLSIQNEDGGWGEDAVSYRLDYKGFEGAPTTASQ |
| TAWALLALMAAGEVENPAVTRGIKYLIDTQTKKGLWDEQRYTATGFPRVFYLRYHGYSKFFPL |
| WALARYRNLRSTNSKVVGVGM |
| |
| >seq_ID 170 |
| MREAVSKVEALQRSKTQGISLEDVERGVAQATRALTALAHDDGHICFELEADATIPSEYILFHHF |
| RGTQVPGDLEAKIGNYLRRTQGRHGGWALVHEGPFDMSCTVKAYFALKMIGDDIEAPHMRRA |
| REGILSRGGAANANVFTRFMLALYGEVPWRAVPVMPVEVMFLPKWFPFHLDKISYWARTTVVP |
| LFVLQATKPRARNPRGISVQELFVTPPESVRSWPGSPHATWPWTPIFGFIDRVLQRVENHLPR |
| KSRQRAMEMARAWVSERLNGEDGLGAIFPAMVNSVLMYEVMGYRPDHPQVRVACDAIEKLV |
| VEKADEAYVQPCVSPVWDTALASHALLEAGGPEAEAQARAGLDWLKPRQVLDIVGDWAARKP |
| KVRPGGWAFQYANAHYPDLDDTAVVVMAMDRAMHQHGLVAGMPDYKASIARAREWVEGLQ |
| SEDGGWAAFDADNNHMYLNHIPFSDHGALLDPPTADVTARVVGMLSQLGETRETSRALDRGV |
| NYLLNDQEEDGSWYGRWGMNFIYGTWSVLCALNAAGVDPADPRIQKAVSWLIRIQNPDGGW |
| GEDASSYKIDPAFEPGSSTASQTAWALLALMAAGAVDDRAVTRGINFLTRTQGADGFWKEERY |
| TATGFPRVFYLRYHGYPKFFPLWAMARFRNLKRGNSRRVQFGM |
| |
| >seq_ID 14 |
| MLLAEVQKALRLAVGHSLDWRADGAWCGEVHSNATFTSQYVFLQQQIGLPLDPTEIEGLSRW |
| LFSQQNEDGSWGLGPGLGGDVSTTTETYLALKILGVSPEDPRMAAARTSIIKAGSLPATRMFTR |
| VFLASFGLIPWSAVPPLPAELILLPTLFPVNIYNLSSWARATCVPLLLIRHHEPLHSLPNGRHAEN |
| DFLDELWTKDIPRDFCYTTPLSRMWRLGDYAGIFFTSADHGLRFLGQYFHSPLRNLSRRKIINWI |
| LDHQEQSGEWAGYWPPQHNNIWALSLEGYSLDHPVLRRGIAAVKSFVLHDATGMRAQVTVSQ |
| VWDTALMSIALSDSAPSTGIISPTQAIDWLMHHEVASHRGDWRVLRPKLATGGFCFEEFNTLYP |
| DVDDTAAVIMALIKSNPAHLISGCVRRAAQWILGMQNRDGGWGAFDWNNDKFFLNKPFSDMD |
| SLCDPSTPDVTGRIIECFGMMMAGRHGYSLDCQLENRLRASSQLAIAYLLGCQENNGSWWGR |
| WGVNYLYGTSNVLCGLAYYYDRSSLSKGDVKSNSNIVSAVDRASEWLKARQHSNGGWGEGP |
| ESYDNAQLAGCGQPTASQSAWVTMALLNYLSPTDEVIQRGVSYLVRNQVKYGDESRATWLLE |
| RYTATGFPGHLYMEYDYYRHYFPIMALGRYVNKLSGSHKLL |
| |
| >seq_ID 180 |
| MTRALRQAPESAGAIGIAAASPATETSGQDTHPREISGAITAARDALLKLQQADGHWCFMLEAD |
| CTIPAEYILWTHFTGELEPEIERKLAARLRAKQASHGGWPLYEGGDLDISCSVKVYYALKLVGD |

| Enzyme Sequences |
| --- |
| DPNAPHMRRAREAILAQGGGARANVFTRLALAMFSQIPWRGVPFIPVEIMLLPRWFPFHLSKVS |
| YWSRTVMVPLAILYSLKAQAQNPRNVHIQELFTVPPEQERHYFPVRSRLNKILLSVERTARLLEP |
| LIPSMLRRRALKKAETWFTERLNGEDGLGGIFPAMVNAHESLILLGYSPDHPWRVQAKKALQNL |
| VIEEKNSASCQPCLSPIWDTGLAALALQETEGGHTTAPVIRALDWLKERQILEQSGDWQVQHP |
| NLKGGGWAFQYNNSYYPDLDDTALVAWSMDQAATPERYGEAIGRACDWLCGMQSRNGGFA |
| AFESDNTHYYLNEIPFADHGALLDPPTADVTARCIVLLGRLNKPQYAETLQRALDYLRREQEPN |
| GSWFGRWGTNYIYGTWSALTALEQANIDPQEGFIRKAVEWLKQVQRLDGGWGEDNYSYFDS |
| SLAGRYQESTPVHTAWALLALMAVGEANSEAVKKGIAYLLQIQQEDGLWDHPAFNAPGFPRVF |
| YLKYHGYDKFFPLWALARYRNHLNRQC |
| >seq_ID 155 |
| MMANATDTIELPPSRAADRIVPMTDIDQAVDAAHAALGRRQQDDGHWVFELEADATIPAEWLL |
| EHYLDRIDPALEERIGVYLRRIQGDHGGWPLYHGGKFDVSATVKAYFALKAIGDDIDAPHMARA |
| RAAILDHGGAERSNVFTREQLALFGEVPWHATPVMPVELMLLPRKALFSVWNMSYWSRTVIAP |
| LLVLAALRPRAINPRDVHVPELFVTPPDQVRDWIRGPYRSQLGRLFKYVDIALRPAERLIPDATR |
| QRAIKAAVDFIEPRLNGEDGLGAIYPAMANTVMMYRALGVPDSDPRAATAWEAVRRLLVELDG |
| EAYCQPCVSPIWDTGLAGHAMIEAASGPKGIRPEDTKKKLAAAAEWLRERQILNGEGRLGDQL |
| PRRAPRRLGLPVQQRLLPRRGRHGSGRHVLHREGDPANDEALERARQWIIGMQSSNGGWGA |
| FDIDNNLDFLNHIPFADHGALLDPPTADVTARCISFLAQLGHPEDRPVIERGIAYLRTDQEREGC |
| WFGRWGTNYIYGTWSVLCAYNAAGVAHDDPSVVRAVDWLRSVQREDGGWGEDCASYEGAT |
| PGIYTESLPSQTAWAVLGLMAVGLRDDPAVMRGMAYLTRTQKDDGEWDEEPYNAVGFPKVEY |
| LRYHGYRQFFPLLALSRYRNLASSNSRHVAFGF |
| >seq_ID 8 |
| MNRMLQPLHSGAGIFRSSLDRVIAQARQALGGRQAEDGHWCFEFEADCTIPAEYILMQHYMD |
| ERDEALEARIAVYLRGKQADHGGWPLYYGGHFDLSASVKVYYALKLAGDDPELPHMRRAREAI |
| LAHGGAERSNVFTRITLALFAQVPWRAVPFIPVEIMLLPRWFPFHIYKVASWSRTVMVPLFILCS |
| LKARAKNPLQVHIRELFRRPPDQITDYFSHARRGIVAYIFLSLDRFWRLMEGWIPHGIRRRALKK |
| AEAWFTARINGEDGLNGIFPAMVNAHEALELLGYPPDHDYRRQTGAALRKLVVERANDAYCQP |
| CVSPVWDTCLALHALLEEDGEVSPAVQNGIRWLKNRQIGAEPGDWRESRPHLAGGGWAFQY |
| ANPYYPDLDDTAAVGWALARAGRAEDRDSIEKAANWLAGMQSRNGGFGAYDVDNTHYYLNEI |
| PFADHKALLDPPTADVTGRVVAFLAHLARPRDRDVLRRAVAYLLREQESSGAWFGRWGTNYIY |
| GTWSVLMALAELNDPSLKPTMERAAYWLRAVQQGDGGWGESNDSYSDPGLAGMGQTSTAA |
| QTAWACLGLMAAGDRDSVALHRGIAWLQAHQEGDGCWQAPFFNAPGFPKVFYLIYHGYAFYF |
| PLWALARYRNLGCMAHE |
| >seq_ID 203 |
| MSMNEAVLAAPRAAVATAAPALQAPIEALSPLDAGIGHAVDALLAQQNADGHWVYELEADATIP |
| AEYVLMVHYLGETPDLSLEARIARYLRRIQNADGGWPLFHEGRSDISASVKAYFALKMAGDDP |
| QAAHMARAREVILAMGGAETSNVFTRTLLALYGVMPWQAVPMMPVEIMLLPQWFPFHLSKVS |
| YWARTVIVPLLVLNSLRPQARNPRKVGIDELFLGSRDAVRLPPRAPHQHKGWHALFHGADVLL |
| RTAEHVMPRGLRRRAIDAAKAFVRERLNGEDGLGAIFPAMANSVMMFDVLGVPPDDPDRAIAR |
| RSIDKLLVVHGDEAYCQPCLSPVWDTALAAHALLEASEPRATAAVTRALDWLRPLQVLDVRGD |

Enzyme Sequences

WTVRRPDVRPGGWAFQYANPHYPDVDDTAVVVAAMHRAARTDHSGRADPNAEATARAIEWI
VGMQSANGGWGAFEPENTHLYLNNIPFADHGALLDPPTADVSARCLSMLCQTGATPDKSEPA
ARALQYLLAEQLPDGSWFGRWGTNYIYGTWSALCALNAAGLGPDAPPLRRAAEWLVAIQNPD
GGWGEDGDSYKLEYRGYETAPSVASQTAWALLALMAAGQAAHPAVTRGIDYLLRTQQADGL
WHEPRFTAVGFPRVFYLRYHGYARYFPLWALARYRNLERSGNRQVAWGL

>seq_ID 165
MREAAVSKVETLQRPKTRDVSLDDVERGVQSATRALTEMTQADGHICFELEADATIPSEYILFH
QFRGTEPRPGLEAKIGNYLRRTQSKVHGGWALVHDGPFDMSASVKAYFALKMIGDDIEAPHM
RAVRKAILQRGGAANANVFTRILLALYGEVPWAAVPVMPVEVMHLPKWFPFHLDKVSYWARCT
MVPLFVIQAKKPRAKNPRGVGVAELFVTPPDSVRTWPGSPHATWPWTPIFGGIDRVLQKTQDH
FPKVPRQRAIDKAVAWVSERLNGEDGLGAIFPAMVNSVLMYEVLGYPPEHPQVKIALEAIEKLV
AEKEDEAYVQPCLSPVWDTALNSHAMLEAGGHQAEANARAGLDWLKPLQILDIKGDWAETKP
NVRPGGWAFQYANPHYPDLDDTAVVVMAMDRAQRQHGLVSGMPDYSESIARAREWVEGLQ
SADGGWAAFDADNNHHYLNHIPFSDHGALLDPPTADVTARVVSMLSQLGETRATSRALDRGV
TYLLNDQEKDGSWYGRWGMNFIYGTWSVLCALNTAGVDPQSPEIRKAVAWLIRIQNPDGGWG
EDASSYKLNPEFEPGYSTASQTAWALLALMAAGEVDDPAVARGVNYLVRTQGQDGLWSEER
YTATGFPRVFYLRYHGYPKFFPLWAMARFRNLKRGNSRQVQFGM >seq_ID 181
MSISPTFSGSSLQKSSLSDHSTISEPFTVVDRVNGISAVALDDAITRARSALLAQQREDGHWCF
SLEADCTIPAEYILMMHFMDEIDTALERRIANFLRNRQVTDGHGGWPLYYGGDFDMSCSVKVY
YALKLAGDSPEAAHMVRARNAILERGGAARSNVFTRLLLAMYRQIPWRGVPFVPAEIMLLPRW
FPFHLSKVAYWSRTVMVPLSILCTLKAKAANPRNIHVRELFTVDPEMEKNYFPVRTPLNHLLLYL
ERLGSKLEPLIPSFIRRRALKKAEQWTIERLNGRDGLGAIFPAMVNAYEALTLLGYDHDHPLLQQ
CRLALRELLVNEGEDITWCQPCVSPVWDTVLASLALQEDERADNGPVRHALDWLVPLQALDQ
PGDWRNSRPDLPGGGWAFQYANPHYPDLDDTAAAAWALCQADTEDYRTSITRAADWLAGM
QSSNGGFAAFDIDNVHYYLNEIPFADHGALLDPPSSDVTARCIGLLALNGEARHQETVKRGLTF
LFNEQEPSGAWFGRWGTNYVYGTWSVLEALKLARVDHDHQAVKRAVQWLKSVQRADGGWG
ETNDSYLDSELAGQLETSTSFQTAWAVLGLMAAGEVGSTAVRNGIDYLIRTQSAAGLWEEPWF
TAPGFPKVFYLKYHGYSKYFPLWALNRYRAMNSRSVV >seq_ID 110
MILFPAGFYFSIYEISYWSRCIVVPLSIAIARKPHVTVGDDLLKELYLVPREDVVYRIERDQDGFC
WYNFFIDADSIFRRYEQHPIKFIRRIAKKMAEKWLLEHMEKSGGLGAIWPAMINSIFAMKCLDYP
DDHPALTAQMKEVEALVIYEGDMLYLQPCVSPVWDTAWSIIAMNDSGIPGSHPVLQKAGKWLL
SKEVRDFGDWKLKCKVEEPSGWYFQYANEFYPDTDDTGAVLMALQRVSLPEDMHKEKTLLRA
LRWLQAMQCDDGGWGAFDRNNNKTILNNIPFADFNALLDPSTSDVTGRCIEFFGRIGFNKTYL
NIKKAVEFLKKEQDEDGSWFGRWGSNYIYGTWSVISGLIAVGEDINKAYIKKAIAWLKSVQNSD
GGWGETIKSYEDSALKGIGKSTPSQTAWALLTLITAGEIKSSSTERGIDFLLSTQKEDGSWDER
EFTATGFPKVFYLKYHMYRNYFPLMALGRYRHFTHKLATSQ >seq_ID 182
MSISQAFFRTLIQKSSLSDSSLVSENFPADDVAGNEANEISAVTLDEAITRAYTALLAQQREDGH
WCFPLEADCTIPAEYILMMHFMDEVDTVLERKIANFLRTRQVTDGHGGWPLYYGGDFDMSCS Enzyme Sequences VKTYYALKLAGDSPEAAHMVHARNAILERGGAARSNVFTRLLLAMYRQIPWRGVPFVPAEIMLL
PRWFPFHLSKVAYWSRTVMVPLSILCTLKAKAINPRNVHVQELFVVDPVKEKNYFPVRTSLNRL
LLYVERLASKLEPFIPSFIRRRAVKKAEQWVIERLNGNDGLGAIFPAMVNAYEALTLLGHDRDHP
LLQQCRQSLRELLVDEGEEITWCQPCVSPVWDTVLATLALQEDKQADSEPIRRALDWIVPLQIL
DEPGDWRDSRPNLLGGGWAFQYANPHYPDLDDTAAVAWALIQTGAEDYRVSITRAADWLAG
MQSSNGGFAAFDIDNAYYYLNEIPFADHGALLDPPTSDVSARCVGLLALNGEVRHQEAVKRGL
DFLFNEQESSGAWFGRWGSNYIYGTWSVLEAFRLARVDKGHQAVQRAIQWLESVQRADGGW
GETNDSYLDPQLAGQLEASTSFQTAWAVLGLMAAGEVENTAVRKGIDYLLRTQIATGLWEEPW
FTAPGFPRVFYLKYHGYSKYFPLWALNRYRTLSSKSAV >seq_ID 162
MSPFLQASDDNNPLFKESCQALDHATEFARDTLVNKEHWCGWVLSNVTVTAEWIFLQYILGLE
MSNEDRRGFLKHFTSSQRPDGSWSLATQTTTGGELSCTIEAYLALKILGVSPEEDYMVRARDY
VRSHGGAEKMRMLSRFHLAMFGLIPWAAVPQMPPELIFMPSWSLVNIYKFSSWARCNIVGLCM
LRVHEPLYALPNGKQLDNDYLDELWLDPYHKAIPYTVPYLQLMQTSPLGVLFQLGDLFLWLLSF
LGFWFLRRWAVSSSIQWTLDHQEPSGDWGGIYPPMHHNILALMLEGWSQDDPVIQRGIGACQ
RFLAEDPAHGKWMQPSVSPVWDTFLMIRAVADAKTTDDADKLLVKPVDWVLAQQIDDDHIGD
WRIYRPDIPAGGFAFEYFNKWYPDVDDTAVGVVALMRHDPSLVNDDRILKAAAWTLGMQNRD
FGWAAFDADNNAFYLHATPFSDMDSLTDSSTPDVTGHVLEMLGLMYRLERQGRVKSPEMLAF
LSQSHGACDRGLGYLLGSQEAFGGWYGRWGVNYIFGTSAALCALAYFADRKGVRGKMAAGA
DWLRSRQNPDGGWGELLESYDNKALAGRGRSTPSQTAWALQGLLELEDPRGEVVEAGVNW
LLRHQVTSPSRNSGRVSATWPEDDYTATGFPGHFYLKYELYCHYFPMMALARYRSCIQDGA >seq_ID 172
MDDRVGAATFEAQPRAGFGSVEAAISRAREALLAVQKPDGHFVFELEADVSIPAEYILFRHFLG
DPAKTEIERKIGVYLRRRQTAAGGWPLFAEGVFNVSSSVKAYFALKIIGDDPNAPHMAKARNAIL
AHGGAAQSNVFTRSLLALYGEVPWRAVPAMPVEIMHLPRWFPFHLSKVSYWGRTVIAPLIVVH
ALKPRAKNPRKISVSELFVAPAETVSRWPGAPHKSFPWTTIFGAIDRVLHKTEPLLPARSHQTAI
DKAVAFVTARLNGEDGLGAIYPAMAYSAMMFFALGAPLSDPRIVQIRKAIDRLLVIKDGEAYCQP
CVSPVWDTALASHALMESAGQRPEARTAPAAAAVFEALDWLKPLQVLDVKGDWATQNPDVR
PGGWAFQYANPHYPDLDDTAVVVLAMDRAVKTSPLIAGEEETAYVEAISRAREWILGLQSANG
GFPGAFDADNDRDYLNYIPFADHGALLDPPTADVTARCVSMLGQLGERPETSPALARAIDYLLSE
QEEEGSWFGRWGMNYIYGTWSVLSAFNAVERPADCAATRKAAAWLKRIQNPDGGWGEDGE
SYALGYKGYNPAPSTASQTAWALLALMAAGEVDAPEVALGLDYLVSTQADDGFWDEARFTAT
GFPRVFYLRYHGYAKFFPLWAMARYRNLKSGNRLKTQFGM >seq_ID 24
MLGAIREPPIDVQIALHSRDDNQTGLVLRGTRRTVDRVLKGLCSSPCFFCSVSLTMATLTTTMA
TTATMATTEASKPLEAQARTALTKATNYAWEIFSNRHWCGELESNVTVTCEHIFFLYVLYQHID
PGEGSQYRQWLLSQQNSDGSWGIAPNYPGDISTSAEAYLALRIIGMSTDSPELYRARTFIRAAG
GLSKMRMFTRIFFAEFGLVPWTAIPQLPAEFILVPAHFPISIYRLASWARSNVVPLLIIAHHRPLYP
LPNGLHKQNPFLDELWLDPATKPLPYGSSDPTDPVAFVFTILDKALSYLGGLRRSPTRGYARRR
CVQWILQHQEKAGDWAGIIPPMHAGIKALLLEGYKLHDEPIQLGLAAIERFTWADNRGKRLQCC

| Enzyme Sequences |
| --- |

ISPVWDTVLMIRALQDTPASLGIKLDPRIADALAWTAENQHRGPEGDWRVYKPNIPVGGWAFE
YHNTWYPDIDDTAAAVLAFLTHDPATARSRLVRDAVLWIVGMQNADGGWAAFDHENNQLFLN
KIPFSDMESLCDPSTPDVTGRTIECLGMLRDLLMRPAENAENGEKYGYPDGEGDAAADAHLLQ
IINTACARAIPYLIRSQEATGTWYGRWAVNYVYGTCLVLCGLQYFKHDPKFAPEIQAMAARAVK
WLKQVQNSDGGWGESLLSYREPWRAGCGPSTPSQTAWALMGILTVCGGEDRSVQRGVRHL
VDTQDDTLSQGDGGAAAWTEREFTIREPLHEASQRIGSD

>seq_ID 26
MATLTTTMATTATMATTEASKPLEAQARTALTKATNYAWEIFSNRHWCGELESNVTVTCEHIFF
LYVLYQHIDPGEGSQYRQWLLLQQNSDGSWGIAPNYPGDISTSAEAYLALRIIGMSTDSPELYR
ARTFIRAAGGLSKMRMFTRIFFAEFGLVPWTAIPQLPAEFILVPAHFPISIYRLASWARSNVVPLLI
IAHHRPLYPLPNGLHKQNPFLDELWLDPATKPLPYGSSDPTDPVAFVFTILDKALSYLGGLRRS
PTRGYARRRCVQWILQHQEKAGDWAGIIPPMHAGIKALLLEGYKLHDEPIQLGLAAIERFTWAD
NRGKRLQCCISPVWDTRVYKPNIPVGGWAFEYHNTWYPDIDDTAAAVLAFLTHDPATARSRLV
RDAVLWIVGMQNADGGWAAFDHENNQLFLNKIPFSDMESLCDPSTPDVTGRTIECLGMLRDLL
MRPAENAENGEKYGYPDGEGDAAADAHLLQIINTACARAIPYLIRSQEATGTWYGRWAVNYVY
GTCLVLCGLQYFKHDPKFAPEIQAMAARAVKWLKQVQNSDGGWGESLLSYREPWRAGCGPS
TPSQTAWALMGILTVCGGEDRSVQRGVRHLVDTQDDTLSQGDGGAAAWTEREFTSTGFPNH
FYISYTLYRVYFPITALGRYLSLIEGGQEKKKKGGGT >seq_ID 171
MGKVETLHRTSTQDITLDDVERRVTLASKALMRLANADGHWCFELEADATIPSEYILYHHFRGSI
PTAELEGKIAAYLRRTQSAQHDGWALIHDGPFDMSATVKAYFALKMVGDPIDAPHMRRARDAIL
RRGGAAHANVFTRIMLALYGEVPWTAVPVMPVEVMLLPRWFPFHLDKVSYWARTVMVPLFVL
QAKKPRARNPRGIGIRELFVEAPERVKRWPAGPQESSPWRPVFAAIDKVLQKVEGFFPAGSRA
RAIDKAVAFVSERLNGEDGLGAIFPAMVNTVLMFEALGYPDDHPFAVTARSSVEKLVTVKEHEA
YVQPCLSPVWDTALAAHALMEAGGTEAERHAKRAMDWLKPLQVLDIKGDWAASKPDVRPGG
WAFQYANPHYPDLDDTAVVVMAMDRVQSRRSPGPDAADYGLSIARAREWVEGLQSRDGGW
AAFDADNTYHYLNYIPFSDHGALLDPPTADVTARCVSMLSQLGETRETCPPLDRGVAYLLADQ
EADGSWYGRWGMNYIYGTWSVLCALNAAGIDPACEPVRRAVTWLTAIQNPDGGWGEDASSY
KLEYRGYERAPSTASQTAWALLALMAAGEADNPAVARGINYLTRTQGADGLWAEDRYTATGF
PRVFYLRYHGYAKFFPLWALARYRNLQRGNSLKVAVGM >seq_ID 173
MLREATAISNLEPPLTASYVESPLDAAIRQAKDRLLSLQHLEGYWVFELEADCTIPAEYILMMHF
MDEIDAALQAKIANYLRHHQSADGSYPLFRGGAGDISCTVKVYYALKLAGDSIDAPHMKKARE
WILAQGGAARSNVFTRIMLAMFEQIPWRGIPFTPVEIMLLPKWFPFHLDKVSYWSRTVMVPLFIL
CSHKVTARNPSRIHVRELFTVEPQKERHYFDHVKTPLGKAILALERFGRMLEPLIPKAVRKKATQ
KAFDWFTARLNGVDGLGAIFPAMVNAYEALDFLGVPPDDERRRLARESIDRLLVFQGDSVYCQ
PCVSPIWDTALTSLTLQEVARHTADLRLDAALSKGLKWLASKQIDKDAPGDWRVNRAGLEGGG
WAFQFGNDYYPDVDDSAVVAHALLGSEDPSFDDNLRRAANWIAGMQSRNGGFGAFDADNTY
YYLNSIPFADHGALLDPPTADVSARCAMFLARWVNRQPELRPVLERTIDYLRREQEADGSWFG
RWGTNYIYGPGAVLLAYEGRRVPNDDPSVRRAVAWLKSIQREDGGWGEDNFSYHDPSYRGR

Enzyme Sequences

FHTSTAFQTGFALIALMAAGEXGSPEVQAGVDYLLRQQRPDGFWNDECFTAPGFPRVFYLKY

HGYDKFFPLWALARYRNERYALA

>seq_ID 117
MNETAFANPAPQVGPAQRQPAAPQEAPAARLPAPALDRGIDRALDALLHQQRPDGHWVYELE

ADATIPAEYVLMVHYLGEDPDRDLEARIARYLRRIQNPDGGWPLFHQGRSDISASVKAYFALKM

AGDDPQSAPMQRARQAIHAMGGAEATNVFTRTLLALYGVLPWKAVPMMPVEIMLLPRWFPFH

LSKVSYWARTVIVPLLVLNSLRPQARNPRGVGINELFVGNCHTVGLPPRAAHQHAGWYTVFRG

LDALLRLAEPLFPRTLRRRAIAAAQRFVRERLNGEDGLGAIFPAMANSVMMFDVLGVPPEDPAR

AVARRSIERLLVEHGDEAYCQPCLSPVWDTALATHALLETGEARAAQAAGRALDWLRPLQVLD

LRGDWAVRRPLVRPGGWAFQYANAYYPDVDDTAVVAAAMDRFMRAHHAPGRYGEAVARAT

EWIVGMQSGNGGWGAFEPENTHLYLNNIPFADHGALLDPPTADVSARCLSMLCQTGATPANS

EPAARALRYLLAEQMPDGSWFGRWGTNYIYGTWSALCALNAAGLPPEAPELCRAVAWLARIQ

NADGGWGEDGSSYRLDYSGYEPAPSVASQTAWALLALMAAGAAQHPAVARGIDYLLRTQQP

GGLWHEPRFTAVGFPRVFYLRYHGYARYFPLWALARYRNLQRGLGDHGGNSGQVAWGL

>seq_ID 204
MSMNETAFATAVPRIAPASAGDSPAPRDAAQALDQGIGRAIDALLHQQRPDGHWVYELEADAT

IPAEYVLMVHYLGEAPDLELEARLARYLRRIQNPDGGWPLFHEGRSDVSASVKAYFALKMAGD

DPQAAHMQRARRAVHALGGAEASNVFTRTLLALYGVMPWLAVPMMPVEIMLLPQWFPFHLSK

VSYWARTVIVPLLVLNSLRPQARNPRGVGINELFVGNCHTVGLPPRAAHQHAGWYTVFRGLDA

LLRVAEPLVPRTLRRRAIAAAQAFVRERLNGEDGLGAIFPAMANSVMMFDVLGVPPDDPARAL

ARQSVERLLVEHGDEAYCQPCLSPVWDTALAAHALLETGEARATAAAGRLDWLRPLQVLDV

RGDWAVRRPLVRPGGWAFQYANAYYPDVDDTAVVAAAMNRYMRAHDVPGRYDEAVARAAE

WIVGMQGGDGGWGAFEPENTHLYLNNIPFADHGALLDPPTADVSARCLSMLCQIGATPGKSE

PAARALRYLLAEQMPDGSWFGRWGTNYIYGTWSALCALNATGLAPEAPEMRRAVAWLEQIQN

ADGGWGEDGSSYRLDYRGYEPAPSVASQTAWALLALMAAGAAQHAAVARGIDYLLRTQQSG

GLWHEPRFTAVGFPRVFYLRYHGYARYFPLWALARYRNLQRGGAHQVPWGL

>seq_ID 79
MRIGTTTNPSMPFPLSSSGAVFYREVNELREVQQEINRIQAFLLQRQQEDGTWRFCLESSPMT

DSHMIILLRTLGIHDERLMEKLTAHITALQHDNGAWKLYPDEQEGHLSTTIDSYYALLLSGKYTK

NEPRMALARSFILEKGGLTQANMLTKFATALTGQYQWPSHFLVPVEIALLPPSFPVSFYDFVGY

ARVHLAPMMIVADRNYVKKPDNAPDLSDLYADTPISRGLYPHRFLENFLKEGQSFLATIHDSLQ

QLPFLPGQLHKLALRRLEQYILARIEPDGTLYNYSTSTFFMIFALLARGFSPKDPLIQKAMQGLTG

SVYDYENGAHLQLATSAVWDTALLTFSLQKSGLSPTHPAIQKANRYLLRKQQHTYGDWKIRNP

NGKPGGWGFSDYNTMNPDIDDTTAALRSLRLLARTDVTAATAWKRGLEWLLSMQNDDGGWP

AFERNTDADFIRHLPIEGADTVSTDPSSADLTGRTLEFLGNYAGRTLTDLHVEKGVRWLLKHQE

SDGSWYGRWGIAYLYGTWAAITGLMAVGFSPTEPAIQKAVAWLVANQNPDGGWGESCQSDL

KKTYVPLGASTPSQTAWAIDALIAVSSKPTAELQRGIRYLLTHNQANDWTTRYPTGGGRPGGT

YFAYHSYRWIWPLLALSHYQVKYANT

>seq_ID 70
MLLYDKVHEEIERRTTALQTMQRQDGTWQFCFEGALLTDCHMIFLLKLLGRNDEIEPFVKRLVS

LQTNEGTWKLYEDEKGGNLSATIQAYAALLASEKYSKEDMNMRRAEMFIKEHGGVSRAHFMT

Enzyme Sequences

KFLLAIHGEYEFPALFHFPTPILFLQDDSPLSIFGLSSSARIHLIPMMICMNKRFRVEKKLLPNLNHI
AGGGGQWFREERSPLIQSFLGDVKKVISYPLSLHHKGYEEVERFMKERIDENGTLYSYASATF
YMIYALLALGHSIQSPIIEKAVTGLKSYIWKMDRGSHLQNSPSTVWDTALLSYSLQEAKVTNENK
MIQRATEYLLQKQQTKKVDWSVHASSLVAGGWGFSDVNTTIPDIDDTTAALRALARSRGNDRV
DDAWGRGVEWVKGLQNNDGGWGAFERGVTSKLLSNLPIENASDMITDPSTPDITGRVLELFG
TYAPNELLEEQKKKAIKWLMDVQEQNGSWYGKWGICYIYGTWATMTGLRALGVPSTHPALKK
AASWLEHLQHEDGGWGESCQSSVEKKFISLPFSTPSQTAWALDALISYYDQETPIIRKGISYLLA
QSTMNEKYPTGTGLPGGFYIRYHSYGHIYPLLALAHYVKKYRK

>seq_ID 140
MAGERSALITALKRSQAADGSWRFPFETGISTDAYMIILLRTLDINDEPLIQALVERIESRQEANG
AWKLFADEGDGNVTATVEAYYALLYSGYRQPTDRHMQKAKRRILDMGGLDRVHLFTKVMLAL
TGQYPWPGRFPLPLEFFLLPPSFPLNMYDLSVYGRANMIPLLIAADSRYSRKTDKSPDLSDLFA
SRGDWGMPESRSLLTYVKRSLIGLPAQLHQAAKQRAVRYLFEHIEPDGTLYSYFSSTFLFIFALL
ALGYRNDDPRIRQAVRGLRSLRTTIDGHVHLQYTTASVWNTALASYTLQEAGVPMTDRAIEKA
NRYLLSRQNVRYGDWAVHNPYSTPGGWGFSDVNTMNPDVDDTTAALRAIRQAAAKETAFRH
AWDRANQWLFSMQNDDGGFAAFEKNVSSRFWRYLPIEGAEFLLMDPSTADLTGRTLEYFGTF
AGLTKDQRAVSRAVDWLLSHQERNGSWYGRWGICYIYGTWAAITGLTAVGVPAHHPALQKAV
RWLLSIQNDDGGWGESCKSDGAKTYVPLGDSTPVHTAWALDALVAAAERPTLEMKAGFRALF
RLLHHPDWTASYPVGQGMAGAFYIHYHSYRYIFPLLALAHYEQKFGPLDD >seq_ID 137
MAGERSALITALKRSQAADGSWRFPFETGISTDAYMIILLRTLDINDEPLIQALVERIESRQEANG
AWKLFADEGDGNVTATVEAYYALLYSGYRQPTDRHMQKAKRRILDMGGLDRVHLFTKVMLAL
TGQYPWPGRFPLPLEFFLLPPSFPLNMYDLSVYGRANMIPLLIAADSRYSRKTDKSPDLSDLFA
SRGDWGMPESRSLLTYVKRSLIGLPAQLHQAAKQRAVRYLFEHIEPDGTLYSYFSSTFLFIFALL
ALGYRNDDPRIRQAVRGLRSLRTTIDGHVHLQYTTASVWNTALASYTLQEAGVPMTDRAIEKA
NRYLLSRQNVRYGDWAVHNPYSTPGGWGFSDVNTMNPDVDDTTAALRAIRQAAAKETAFRH
AWDRANQWLFSMQNDDGGFAAFEKNVSSRFWRYLPIEGAEFLLMDPSTADLTGRTLEYFGTF
AGLTKDQRAVSRAVDWLLSHQERNGSWYGRWGICYIYGTWAAITGLTAVGVPAHHPALQKAV
RWLLSIQNDDGGWGESCKSDGAKTYVPLGDSTPVHTAWALDALVAAAERPTLEMKAGFRALF
RLLHHPDWTASYPVGQGMAGAFYIHYHSYRYIFPLLALAHYEQKFGPLDD >seq_ID 136
MVADERSALIDALKRSQSVDGSWRFPFETGISTDAYMIILLRTLGIHDEPLIQALVERIESRQDAN
GAWKLFADEGDGNVTATVEAYYALLYSGYRKKTDSHMQKAKARILEVGGLERVHLFTKVMLAL
TGQHSWPRRFPLPLVFFLLPPSFPLNMYDLSVYGRANMVPLLVVAERRYSRKTDNSPDLSDLA
ASRNDWRLPDTEALWSYVKRSLTGLPAWLHRAAEQRAVRYMLEHIEPDGTLYSYFSSTFLLIFA
LLALGYPKDDPHIARAVRGLRSLRTEIDGHTHMQYTTASVWNTALASYALQEAGVPPTDRTIEK
ANRYLLSRQHIRYGDWAVHNPYGVPGGWGFSDVNTMNPDVDDTTAALRAIRRAAAKETAFRH
AWDRANRWLFSMQNDDGGFAAFEKNVGKRFWRYLPIEGAEFLLMDPSTADLTGRTLEYFGTF
AGLTKDHSAIARAIDWLLDHQEADGSWYGRWGICYVYGTWAAVTGLSAVGVPIDHPAMQKAV Enzyme Sequences RWLLSIQNDDGGWGESCKSDGAKTYVPLGASTPVHTAWALDALIAAAERPTPEMKAGVRALV
RMLHHPDWTASYPVGQGMAGAFYIHYHGYRYIFPLLALAHYEQKFGPFVD >seq_ID 49
MLLYEKVYEEIARRTTALQTMQRQDGTWRFCFEGAPLTDCHMIFLLKLLGRDKEIEPFVKRLAS
LQTNEGTWKLYEDEVGGNLSATIQSYAALLASEKYTKEDANMKRAEMFINERGGVARAHFMTK
FLLAIHGEYEYPSLFHLPTPIMFLQNDSPLSIFELSSSARIHLIPMMLCLNKRFRVGKKLLPNLNHI
AGGGGEWFREDRSPVFQTLLSEVKKIITYPLSLHHKGYEEVERFMKERIDENGTLYSYATASFY
MIYALLALGHSIQSPIIQKAITGIASYIWKMERGSHLQNSPSTVWDTALLSYALQEAQVPKASKVI
QNASAYLLRKQQTKKVDWSVHAPNLFPGGWGFSDVNTMIPDIDDTTAVLRALARSRGDENVD
NAWKRAVNWVKGLQNNDGGWGAFEKGVTSRILANLPIENASDMITDPSTPDITGRVLEFFGTY
AQNELPEKQKQSAINWLMNVQEENGSWYGKWGICYIYGTWAVLTGLRSLGIPSSDPSLKRAAL
WLEHIQHEDGGWGESCQSSVEKRFVTLPFSTPSQTAWALDALISYYEKETPIIRKGISYLLSNPY
VNEKYPTGTGLPGGFYIRYHSYAHIYPLLTLAHYTKKYRK >seq_ID 62
MNIVIRISKGWVSNLLLDEKAHEEIVRRATALQTMQWQDGTWRFCFEGAPLTDCHTIFLLKLLG
RDKEIEPFVERVASLQTNEGTWKLYEDEVGGNLSATIQSYAALLASKKYTKEDANMKRAENFIQ
ERGGVARAHFMTKFLLAIHGEYEYPSLFHVPTPIMFLQNDSPFSIFELSSSARIHLIPMMLCLNKR
FRVGKKLLPNLNHIAGGGGEWFREDRSPVFQTLLSDVKQIISYPLSLHHKGYKEIERFMKERIDE
NGTLYSYATASFYMIYALLALGHSLQSSMIQKAIAGITSYIWKMERGNHLQNSPSTVWDTALLSY
ALQEAQVSKDNKMIQNATAYLLKKQHTKKADWSVHAQALTPGGWGFSDVNTTIPDIDDTTAVL
RALARSRGNKNIDNAWKKGVNWIKGLQNNDGGWGAFEKGVTSKLLAKLPIENASDMITDPSTP
DITGRVLEFFGTYAQNELPEKQIQRAINWLMNVQEENGSWYGKWGICYIYGTWAVMTGLRSLG
IPSSNPSLTRAASWLEHIQHEDGGWGESCHSSVEKRFVTLPFSTPSQTAWALDALISYYDTETP
AIRKGVSYLLSNPYVNERYPTGTGLPGAFYIRYHSYAHIYPLLTLAHYIKKYRK >seq_ID 59
METLIDPEISRLTQRLLEDQEEDGAWRYCFENSLMTDAYMIVLIRSLGIKKERLVQELADRLLSQ
QEEKGFWKIYRDEVEGNLSATVEAYFALLWSGAVKEKDENMVKARDCILSGGGLDKVHSMTK
FMLAAHGQYPWDRFFPVPVEVILLPTYFPVSFTDFSAYARVHLAPLLLLKSERYIRKTSTTPDLS
YLLKDQEDFSFFREEERSFIEYVTSGVEAIAAFPANLNDLAKKTALNYMLARLEPDGSLYSYFSS
SFYMIIALLSQGYSRKDPLVVNAIKALISYQCKGDGYPHIQNSPSTIWDTALISHALQSSGVDSRN
AQILKASHYLYRHQHTQKGDWASEAPQTAPGGWGFSESNTINPDVDDTTAALRALKLDAYTDP
VKRMAWNRGVKWALSMQNKDGGWPAFEKNKNKDILSWVPMDGAEDAALDRSCADLTGRTL
EFLGNDAGMGRENSQVLKGIEWLMNNQENDGSWYGKWGICYIYGTWAALTGMMAAGMSAD
HQSIIKAIKWLYQIQNSDGGWGESCRSDKERKYISLGASTPSQTAWALDALISINDHPTKEIDRGI
ESLVRLLNTDDWRKEYPTGAGLPGRFYIHYHSYPYIWPLLALSNYKTKFLEVR >seq_ID 51
MVLYGRVCAEIERTITALHTMQQQDGAWRFCFEGSPLTDCHMIFLLRLLEKEEEIEPFVARLTSI
QTNEGTWKLYEDERAGNVSTTIQAYAALLASGMYTKEDVNMKRAEAFIQERGGIARSHFMTKF
LLALHGGYEYPRMYFPTPILFLPEDSPLSIFELSSSARIHLIPMMICMNKRFTVSKTILPNLDHIS
GSSKSEWFREDRSSLFETILGEVKKFVTYPLSLHHKGDKEAERFMIERIDRNGTLYSYASATFY
MIYALLALGHHIQSPLIQQAVAGLRTYKWHMEAGIHLQNSPSTVWDTALLSYALQEANVNESTP

Enzyme Sequences

MIQTATEYIWQRQHHEKKDWSLHAPTLSPGGWGFSDVNTTIPDVDDTTAALRALARSRKRNR

RIEEAWKKGVNWKKGLQNKDGGWAAFEKGVTNRFLTHLPLENSGDMMTDPSTADITGRVLEF

FGTYAPNELQDHQKNRAITWLMDVQENNGSWYGKWGVSYIYGTWAALTGLRAVGVANTHPA

LKKAVMWLERIQHRDGGWGESCRSSIEKRFVPLSFSTPSQTAWAIDALISYYDEETPVIRKGISY

LLEHAASHQEYPTGTGLPNGFYIRYHSYSYMYPLLTFAHYINKYRK

>seq_ID 32
MLLYEKAHEEIVRRATALQTMQWQDGTWRFCFEGAPLTDCHMIFLLKLLGRDKEIEPFVERVA

SLQTNEGTWKLHEDEVGGNLSATIQSYAALLASKKYTKEDANMKRAENFIQERGGVARAHFMT

KFLLAIHGEYEYPSLFHLPTPIMFLQNDSPFSIFELSSSARIHLIPMMLCLNKRFRVGKKLLPNLN

HIAGGGGEWFREDRSPVFQTLLSDVKQIISYPLSLHHKGYEEIERFMKERIDENGTLYSYATASF

YMIYALLALGHSLQSSMIQKAIAGITSYIWKMERGNHLQNSPSTVWDTALLSYALQEAQVSKDN

KMIQNATAYLLKKQHTKKADWSVHAPALTPGGWGFSDVNTTIPDIDDTTAVLRALARSRGNKNI

DNAWKKGGNWIKGLQNNDGGWGAFEKGVTSKLLAKLPIENASDMITDPSTPDITGRVLEFFGT

YAQNELPEKQIQRAINWLMNVQEENGSWYGKWGICYLYGTWAVMTGLRSLGIPSSNPSLTRA

ASWLEHIQHEDGGWGESCHSSVEKRFVTLPFSTPSQTAWALDALISYYDTETPAIRKGVSYLLS

NPYVNERYPTGTGLPGAFYIRYHSYAHIYPLLTLAHYIKKYRK

>seq_ID 31
MSTIHENVRSRQKKTISLLRETQNADGSWSFCFEGPILTNAFLILLLTSLGDNDKELIAELAEGIR

AKQRPDGTFANYPDDRKGNVTATVQGYAGLLASGLYSRSEAHMIQAERFIISNGGLRNVHFMT

KWMLAANGLYPWPALHLPLSFLVIPPTFPLHFYQFSTYARIHFVPMAVTLNKRFSLKNPNVSSL

AHLDRHMTKNPFTWLRSDQDENRDLSSLFAHWKRLLQIPAAFHQLGLRTAKTYMLDRIEEDGT

LYSYASATIFMVYGLLALGVSRHSPVLRKALAGTKALLTSCGNIPYLENSTSTVWDTALLNYALM

KSGISDNDQMITSAARFLRERQQKKVADWAVHNPHAEPGGWGFSNINTNNPDCDDTAAVLKAI

PRKLYPASWERGLSWLLSMQNSDGGFSAFEKNVNHPLVRLLPLESAEEAAIDPSTSDLTGRVL

HCLGEAGLSSDHPQIEKAVQWLIRHQEEDGSWYGRWGVCYIYGTWAALTGMKACGVSQNHP

AVKKAIRWLKSIQNEDGSWGESCKSAEEKTYVPLSYGTLVQTAWAAEALLQYEKTHHQAVTKG

ISFLIENRHYEGAAFSYPTGIGLPKQFYIRYHSYPYVFSLLALSTFMKMSEKEEEK

>seq_ID 48
MLLYEKAHEEIARRATALQTMQRQDGTWRFCFEGAPLTDCHMIFLLKLLGRDKEIEPFVKRLAS

LQTNEGTWKLYEDEVGGNLSATIQSYAALLASKKYTKEDANMKRAENFIKERGGVARAHFMTK

FLLAIHGEYEYPSLFHLPTPIMFLQNDSPLSIFELSSSARIHLIPMMVCLNKRFRVGKKLLPNLNHI

AGGGGEWFREDRSPLFQTLLSDVKQIISYPLSLHHKGYEEVERFMKERIDENGTLYSYATASFY

MIYALLALGHSLQSSLIQKAIAGITSYIWKMERGSHLQNSPSTVWDTALLSYALQEAHVPKDHKM

IQQTITYLLKKQHTKKADWSVHALALTPGGWGFSDVNTTIPDVDDTTAVLRALARSRGNENIDN

AWKKGVNWIKGLQNNDGGWGAFEKGVTSKLLANLPIENASDMITDPSTPDITGRVLELFGTYT

QNELPKKQKQSAINWLMNVQERNGSWYGKWGICYIYGTWAVMTGLRSLGIPSNNPSLKRAAL

WLEHIQHEDGGWGESCQSSVEKRFVTLPFSTPSQTAWALDALISYYDKETPTIRKGVSYLLAN

PYVNEKYPTGTGLPGGFYIRYHSYAQIYPLLTLAHYTKKYQK

>seq_ID 34
MNIVIRISKGWVSNLLLYEKVHEEIARRTTALQSMQRQDGTWRFCFEGAPLTDCHMIFLLKLLG

RDKEIEPFVKRLASLQTNEGTWKLYEDEVGGNLSATIQSYAALLASEKYTKEDANMKRAEMFIN

Enzyme Sequences

ERGGVARAHFMTKFLLAIHGEYEYPSLFHLPTPIMFLQNDSPLSIFELSSSARIHLIPMMLCLNKR

FRVGKKLLPNLNHIAGGGGEWFREDRSPVFQTLVSDVKKIITYPLSLHHKGYEEVERFMKERID

ENGTLYSYATASFYMIYALLALGHSLQSSMIQKAIAGITSYMWKMESGNHVQNSPSTVWDTALL

SYALQEAHVLKDNKMLQNATAYLLKKQHTKKADWSVHAPALTPGGWGFSDVNTTVPDVDDTT

AVLRVLARSRGNEKVDHAWQKGINWVKGLQNNDGGWGAFEKGVTSHILANLPIENASDMITD

PSTPDITGRVLEFFGTYAQNELPEKQKQSAINWLMNVQEENGSWYGKWGICYIYGTWAVLTGL

RSLGIPSSDPSLKRAALWLEHIQHEDGGWGESCQSSVEKRFVTLPFSTPSQTAWALDALISYY

DKETSVIRKGISYLLSNPYINETYPTGTGLPGGFYIRYHSYAHIYPLLTLAHYAKKYRK

>seq_ID 47
MLLYEKVHEEIVRRATALQTMQWQDGTWRFCFEGAPLTDCHMIFLLKLLGREKEIEPFVERIAS

LQTNEGTWKLYEDEVGGNLSATIQSYAALLASKKYTKEDANMKRAENFIKERGGVARAHFMTK

FLLAIHGGYEYPSLFHLPTPIMFLQNDSPLSIFELSSSARIHLIPMMLCLNKRFVGKKLLPNLNHI

AGGGGEWFREDRSPVFQTLISDVKQIISYPLSLHHKGYEEIERFMKERIDENGTLYSYATASFY

MIYALLALGHSPQSSMIQKAIAGLTSYIWKMGRGSHLQNSPSTVWDTALLSYALQEARVSKDNK

MIQNATAYLLKKQHTKKADWSVHAPALIPGGWGFSDVNTTIPDIDDTTAVLRALARSRGNKNID

NAWQKGVNWIKGLQNNDGGWGAFEKGVTSKLLANLPIENASDMITDPSTPDITGRVLEFFGTY

AQNGLPEKQKQSAINWLMNAQEENGSWYGKWGICYIYGTWAVMTGLRSLGIPSSNPSLKRAA

SWLEYIQHEDGGWGESCHSSVEKRFVTLPFSTPSQTAWALDALISYYDTETPAIRKGVSYLLSN

PYVNERYPTGTGLPGAFYIRYHSYAHIYPLLTLAHYLKKYRK

>seq_ID 52
MRSILEDVKAFRQKTLAELQNRQRSDGSWRFCFEGPVMTDSFFILMLTSLGDQDSSLIASLAER

IRSRQSEDGAFRNHPDERAGNLTATVQGYTGMLASGLYDRKAPHMQKAEAFIKDAGGLKGVH

FMTKWMLAANGLYPWPRAYIPLSFLLIPSYFPLHFYHFSTYARIHFVPMAITFNRRFSLKNNQIG

SLRHLDEAMSKNPLEWLNIRAFDERTFYSFNLQWKQLFQWPAYVHQLGFEAGKKYMLDRIEE

DGTLYSYASATMFMIYSLLAMGISKNAPVVKKAVSGIKSLISSCGKEGAHLENSTSTVWDTALIS

YAMQESGVPEQHSSTSSAADYLLKRQHVKKADWAVSNPQAVPGGWGFSHINTNNPDLDDTA

AALKAIPFQRRPDAWNRGLAWLLSMQNKDGGFAAFEKDVDHPLIRNLPLESAAEAAVDPSTAD

LTGRVLHLLGLKGRFTDNHPAVRRALRWLDHHQKADGSWYGRWGVCFIYGTWAALTGMKAV

GVSANQTSVKKAISWLKSIQREDGSWGESCKSCEAKRFVPLHFGTVVQSSWALEALLQYERP

DDPQIIKGIRFLIDEHESSRERLEYPIGIGLPNQFYIRYHSYPFVFSLLASSAFIKKAEMRETY

>seq_ID 188
MRSELLQLQSADGSWRLCFDSGTMPDSYFIIILRMLGYSQDEALIRQIASRILSRQLPNGTWKIY

PDEEDGNLDATAEAYFALLYSGFLTKLDPRMQLAKQFILSKGGLSKIRSLLTQAIFAAAGQASWP

KSMRIPLEVFFSDNGIGIDLFSLSGHARVHIVPIIMLANAQFVQHSASMPDLSDLFAGSSKRFEN

DSPWIAALATLIGSLSLSELLPFESPTPQEKAVQFLFDRLEPDGTLLTYTTATMFMILVLLMLGYS

SSSPLIHRMVSGIHSVICANSHVQIASSEVWDTAMLVHALRKAGVNPTSTALENAGAYLRQRQQ

TQLGDWAIRNPGTPAGGWGFSNVNTLYPDVDDTTAALRAIQPYSSRTPELQADWQRGLNWVL

TMRNDNGGWPAFERQGSRLPITFFNFEGAKDIAVDPSTVDLTSRTLQFLGQELGMNAGNSWIE

STLRWVLSQQESNGSWYGRWGITYVHGTSAALQGLTAVGIAEDHPAVKKGVDWLLQVQNED

| Enzyme Sequences |
|---|

GGWGESCISDKVRRYVPLNFSTPSQTAWALDGLTAALPKPTPALERGVDALLQSLDRHDWTY

TYPTGGALPGSVYAHYASNNYIWPLLALSNIWQKYS

>seq_ID 60
MGTLQEKVRREQKKTITELRDRQNADGSWTFCFEGPIMINSFFILLLTSLDEGENEKELISSLAA

GIHAKQQPDGTFINYPDETRGNLTATVQGYVGMLASGCFHRTEPHMKKAEQFIISHGGLRHVH

FMTKWMLAANGLYPWPALYLPLSLMALPPTLPIHFYQFSSYARIHFAPMAVTLNQRFVLINRNIS

SLHHLDPHMTKNPFTWLRSDAFEERDLTSILLHWKRVFHAPFAFQQLGLQTAKTYMLDRIEKD

GTLYSYASATIYMVYSLLSLGVSRYSPIIRRAITGIKSLVTKCNGIPYLENSTSTVWDTALISYALQ

KNGVTETDGSVTKAADFLLERQHTKIADWSVKNPNSVPGGWGFSNINTNNPDCDDTTAVLKAI

PRNHSPAAWERGVSWLLSMQNNDGGFSAFEKNVNHPLIRLLPLESAEDAAVDPSTADLTGRV

LHFLGEKVGFTEKHQHIQRAVKWLFEHQEQNGSWYGRWGVCYIYGTWAALTGMHACGVDRK

HPGIQKALRWLKSIQNDDGSWGESCKSAEIKTYVPLHRGTIVQTAWALDALLTYENSEHPSVVK

GMQYLTDSSSHSADSLAYPAGIGLPKQFYIRYHSYPYVFSLLAVGKYLDSIEKETANET

>seq_ID 56
MQDFKTKVNVYMDELHMQMQHRQREDGAFVFCFEGSMMTNAFLIMLLKAVGDTDQALVHQL

AEAIREKQNEDGSFSLYHDQAGHVTATVQGYCGMLVSGRYQQDEPHMEKAARYIRSKGGLKD

VHFMTKWMLAVNGMHPWPYFYAPLSFLLIPTYFPLHFYHLSAYARIHFVPMMIALNKRYTSHEQ

FPSLSHLDANMSKNPFDWFMAREERSTHHFLAYMRSYTALDSRFDFFGYEAAKRYMFDRLEK

DGTLYSYLSASIFMVYALMSLGYSPGHHLILKAVKGMKQLVTDCGGKKYAENSTSTVWDTALV

SYASQRAGRTQDDPVIKKSFTYLLNRQQMKKADWAIHNRHAAPGGFGFSDLNTNNPDCDDTQ

IVLKAIPQTYAPVQWKRGFDWLLSMQNRDGGFSAFEKNQDHFLLRHLPLESAEDAAIDPSTPDI

TGRVLHLIASEENDKSPLMQRQKDHCVKWLLDHQEKDGSWYGRWGVCYIYGTWAALTGLKA

SGIPSSHPAVQKACRFLKTIQLEDGSFGESCKSSEVKRYVPLPFGTVVQTAWAAEALLQYVQP

DDKSILKAISFLIQHQHSSKALHYPVGIGLPKQFYITYHSYPFVFPMMACSTFLEEMRRKNE

>seq_ID 58
MKNRNKGAGCMQLVKSEIERLKQQLLSEQTPDGSWNHPFDTGCMTDIYMIVLLRTLEEEDEEE

LIKELAKGILSRQGKDGAWRLFHDHHEGSLSLTIEAYYALLYSGYYEKNHPALVKARRVITKGGG

LKKAGMYTKIMLALTGQYPWPLLFPVPMEVILLPRSFPLNMYDISVFGRSNLIPVILLGNKKFSRK

TALSPDLGDLSVRDDDDPWPELRSAEWRSLTSFLAAGVKALVGIPRQIRAWSIEKAREYMQSH

TEPDGTLYNYFSSTFYMIFALLALGGGPEEPAIRNAVAGLKRMTVKADGRTHIQYTTAAVWNTA

LISHALQEAGVPPKENAIQKANQYLAGQQHRRFGDWIVHNTKAEPGGWGFSRFNTINPDVDDT

TAALRSLYQPAREKPHYDDIWKKGLLWTLSMQNRDGGWPAFERNVDKKLLHLLPIQGAEFILT

DPSTADLTGRTLEFLGKAGYADASLPPIKKAVKWLKKHQEPNGSWYGRWGICYIYGTWAAVTG

MAAVGVTLEDKSMKKGIDWLLSIQNEDGGWGESCRSDMEKKYIPLKESTLTQTAWAVDALAAA

GMADSTPSRKGAAFLVREGKRKDWTADYPMGQGMANFFYIHYHSYRCIWPLLALSHYIEKSEA

PD

>seq_ID 57
MQDFKTKVNEYIDELHMQLRRQREDGAFVFCFEGPMMTNAFLIMLLKAVGDSDQALVHQLA

EAIREKQNEDGSFSLYHDQAGHVTATVQGYCGMLVSGRYQQDEPHMEKAAHFIRSNGGLKDV

HFMTKWMLAVNGMHPWPYFYAPLSFLLIPTYFPLHFYHLSAYARIHFVPMMIALNKRYTSHEQF

PSLAHLDANMSKNPFDWFMAREERSTHHFLAYMRSYTALDSRLDFFGYEAAKRYMFDRLEKD

Enzyme Sequences

GTLYSYLSASIFMVYALMSLGYSPGHHLILKAVKGMKQLVTDCGGRKYAENSTSNVWDTALVS

YASQQAGRTQDDPVIKKSFTYLLNRQQMKKADWAIHNRHAAPGGFGFSDLNTNNPDCDDTQI

VLKAVPQTYAPVQWKRGFDWLLSMQNQDGGFSAFEKNQNHFLLRHLPLESAEDAAIDPSTPDI

AGRVLHLIALEENSMSPLMQRQKDHCVKWLLDHQEKNGSWFGRWGVCYIYGTWAALTGLKT

AGISSSHSAVQKACRFLKTIQLEDGSFGESCKSAEVKRYVPLPFGTVVQTAWAAEALLQYVQP

DDKVILKAISFLIQHQHSSEALHYPVGIGLPKQFYITYHSYPFVFPMMACSTFLEEMRRKNE

>seq_ID 61
MGTLQEKVRRFQKKTITELRDRQNADGSWTFCFEGPIMTNSFFILLLTSLDEGENEKELISSLAA

GIHAKQQPDGTFINYPDETRGNLTATVQGYVGMLASGCFHRTEPHMKKAEQFIISHGGLRHVH

FMTKWMLAANGLYPWPALYLPLSLMALPPTLPIHFYQFSSYARIHFAPMAVTLNQRFVLINRNIS

SLHHLDPHMTKNPFTWLRSDAFEERDLTSILLHWKRVFHAPFAFQQLGLQTAKTYMLDRIEKD

GTLYSYASATIYMVYSLLSLGVSRYSPIIRRAITGIKSLVTKCNGIPYLENSTSTVWDTALISYALQ

KNGVTETDGSVTKAADFLLERQHTKIADWSVKNPNSVPGGWGFSNINTNNPDCDDTTAVLKAI

PRNHSPAAWERGVSWLLSMQNNDGGFSAFEKNVNHPLIRLLPLESAEDAAVDPSTADLTGRV

LHFLGEKVGFTEKHQHIQRAVKWLFEHQEQNGSWYGRWGVCYIYGTWAALTGMHACGLTESI

PVYKRLCVGSNPYKMMTEAGENPAKAPKSKHMYRFIEEPLYKRPGL

>seq_ID 50
MAEAISYPRRVHIITTKFPVNFYDFSVFGRSNIAPILLLADSKFQIPKTTETPDISHLYVRELYWWS

EDRGWNGFTKAINKGVNNLIGLPNELHTLGRKQAENYMLDRLEDDGTLLSYYSSTFFMIYALLS

VGYTKDHKVIKKAARGLLSMNTTVKDTIHIQYTTAHIWNTSLISHALQTAGASPDDTMVMRANH

YLLQRQHTKFGDWAIYQPNLGPGGWGFSHSNTFNPDVDDTTASLRSIQNSLHSHPNYQSSWY

RGLSFTLGMQNDGGFPAFEKGVDKTFLFILLPVQGAEFLLTDPSTPDLTGRTLEFLGESAHLY

KDSGAIKRGVNWLIENQRRDGSWYGRWGICYIYGTWAALTGLQAVGVSKEHPSVQEGIDWLK

SIQQDDGGWGESCESDSQKTYIPLSKSTVTQTAWAVDALIAYEKEETVEIKKGMEYLLENWNH

EDWTMDYPMGQGMAKAFYIHYHSYRYVFPLLTMGHYMRKFM

>seq_ID 199
MSETISCQRIQAAYQRSRAELLSLRNSTGHWTGELSTSALSTATAIMALEMIRRKRLPADLSLNT

YIDNGIRWLAEHQNSDGGWGDTVKSFSNISTTMLCHAVFHATKSTEQYVSHVVNARQYIDRVG

GVEAVVARYGKDKTFSVPILTHCALAGLVKWKTIPALPFELACLPARFYKTVRLFVVSYALPALIA

IGQVRHHFCKPRNPITRLIRKLAVKRSLKKLISIQPSNGGFLEAAPLTSFVTMSLAGMGLTDHPV

VQKGLQFLLDSVRPDGSWPIDTNLATWTTTLSVNALEGTLAEFEKTPIREWLLQQQYKELHPYT

SAEPGGWAWTDLPGGVPDADDTPGAILALLNLQPDEPDTQQPADLQVALRNGVKWLLDLQNS

NGGWPTFCRGWGALPFDQSAADISAHVIRALQAWLQTEPESAEAELRLRAERAVRKCFKYLAT

VQRPDGSWLPLWFGNQHVENDENPVYGTARVLAAYAQGEQCGSIQAEQGILFLKSVQNLDG

GWGGATSAPSSVEETALAVDTLLALGLEPADPVVAQGLNWLSGRVENGTYTETTPIGFYFAKL

WYFEQLYPIIFTVSALHRAETVLKKSADDNLRLSLEEEDYPIMSVKEK

>seq_ID 75
MDQDRLQRCYAIARDDLLAQRNGQGHWTGELSTSALSTATAVSALQLVVRHDPAQSERLMPLI

EGGVRYLTEHQNPDGGWGDTDRSYSNIATTMLAVAALTIAERREALFEQLAFAENYIEAQGGIP

GLRRRYGKDKTFAVPILTNYALAGLVDWREVSPLPFELACLPQKFYKLVKLPVVSYAIPALVAIG

QARYFHRPPFNPLMRGLRGAAVKKSLAVLERMQPASGGYLEAAPLTSFVVMSLASIGNASHPV

Enzyme Sequences

AQNGVQFLVDSVREDGSWPIDSNLANWVTTLSISALATGGDDIAELDCLPWVLANQYQETHPF
TGADPGGWGWTDLSGSVPDADDTPGAMLAIAHFFHSPRADNETRRQIASAAISGARWLLDLQ
NSDGGWPTFCAGWGTQPFDRSGSDLTAHAIRALHAWRSELGDLPVERAIERGLRYLQKQQR
DDGSWLPLWFGNQDIHDDENPIYGTVKVLLAYRDLGKMSSETAQRGAAWLAARQNEDGGFG
GGPSISTLCGGPGESSVEETALAIEALFAAENSNISAEIVPPAVGWLCQRVEEGSYVNCTPIGFY
FSKLWYYEKLYPRVMTVTSLGAALQANASVPPAPETVTTSSDH

>seq_ID 325
MATSDPSLAEAIQNTRAHLLSLRNARGHWEGHLSNSALSTATAIVALHLVDAPLHSARIAQGVR
WLVLHQNKDGGWGDTTLSKSNLSTTLLCWSALSLCEPDRTEPIQHCEAWIKERTGSLEPEVIC
RAVVARYGKDKTFSVPILMLCAIGGRLGPEKEAWSRVLALPFELAAMPREWFGAIGLPVVSYAL
PALIAIGYARFYHAPPSLLNPLHALRKALWPRISPMLKLLQPSTGGYLEATPLTSFVTMALASAG
EKFHPCVPEAVRFLEDSQRPDGSWPIDTNLATWGTTLSTKALTATSEGREALDIPALKSWLLEQ
QYQEIHPFTNAAPGGWAWTDLPGGVPDADDTSGALVALWHLCEDEAERQALAPAVAKGVQW
LMDLQNRDGGIPTFCRGWGTLPFDRSTPEITAHALHAWGLWQVVLPEELQQEVSLRIPRAIAFI
ARPPSRGAPGFNHVPLWFGNEHAKEEENHVYGTAQIMNHLLSSGLNTPEIKVILETGHRNLLA
WQQLDGGWSGSETGPASLEETAVSVAALALHTLHAGNRTRSSAEDAVAKGTQWLVQHTATG
TTFPSAPIGLYFARLWYHEQLYPVIWTLGALHAVETLSAAALPLRARASAPPQHPGVVRTKPIHI
APPSDP >seq_ID 135
MIPAERLRTAYRTARAALLAERVPEGHWVGELSTSALSTATAVMALHLVNPFTHRELIDAGRKW
LAEHQNADGGWGDTVKSFSNISTTMLCRAAFKLAGEKEYPETVQRVEEYLSRNAGALPTARAA
AIRARYGKDHTFSVPILMTCAVAKLVPWDEVPRLPFELACLPQSWYRFAKLPVVSYALPALIAIG
QCIHHHRRSQNPIRNTVRRLARGLSLKVLRRIQPTSGGYLEATPLTSFVVMALSSIRRRRAAAE
QQVIDEGVRFLVASVRPDGSWPIDTNLATWVTTLSVNALATAGDLEALDTKEQILAWLLKQQYK
ERHPYTGADPGGWAWTDLPGGVPDCDDTPGALIALAHLDPKSDPQAVLSGLRWVLRLQNGD
GGAPTFCRGWGTLPFDRSGADLTAHSVRSLASWYRVWGAGPPPIEHLRHRLKDLEFPLSGLF
WDVARRNPRFVRYLKKQQRSDGSWLPLWFGNQHAPDDINPVYGTARVLAAYRDLELKDAPE
CRRGIEFLLSVQNADGGWGGAKGCPSSVEETALAVEVLLDLADGDAVQKGVAWLAEAVESDR
FRDASPIGFYAKLWYFEKLYPIIFTVAALGRAVKITSPAPAAESA >seq_ID 115
METLSRSRLEAALAKATQALLTELNPAGHWSGELSSSALSTATAIVALGAVDREQQRELIAGGM
RWLAQHQNADGGWGDTVKSRSNISTTALCWAAVSTSTEHAESAAKAEAWLTRAAGSMAQLV
PAIEARYGKDRTFSVPILMHLAICGRVSWSQIPALPFELAALPHQLFGALQLPVVSYALPALIAIG
QAIHHHAPPTNPLLNGLRKSARARTLEVLESIQPQNGGFLEATPLTSFVTMALASAGEAQHPVA
RRGVSFLQASVQRDGSWAIDTNLATWVTTLSIKALAHQPGALSPERALTLREWLLGQQYVVEH
PYTHAAPGGWAWTDLPGGVPDADDTPGALLALLHLGVVDAPTRQAGQIGVRWLLDLQNRDG
GIPTFCRGWGALPFDRSSPDLTAHTLRAWTAWLPQLDESLKRRTLRAVTKAIHFLATHQRTDG
SWLPLWFGNEHAPDDENPLYGTAKVVIALRELLNRDFTLPNGMLERALCWLVERQDISGGWS
GAKNGPVSVEETALAVEALAGTGHVSATDRGAAWLTEQIEADTWREPAPIGFYFAKLWYYERL
YPQIWTVGALGRVAALRVGESESDTPAGLHRATSET

| Enzyme Sequences |
| --- |

>seq_ID 208
MMAVVENSVSEVLDRRELRGTLDLLRGELLAQRTKDGHWTGELSASALSTATAISAMSAAVRS
GKLAGADKAALLEQIQSGRRWLADQQNDDGGFGDTDRSHSNIATSYLVLAAWTLSDQVTGET
TDANAISRLRNWIQLAGELDGLRRRYGKDKTFVVPILTNMAIAGLVPWKKVSALPFEAAVVPQS
MYRFVGMPVVSYAVPALVAIGQVKFLEGGGCLPPWSLVRRAAIEPSMKVLRSMQPSSGGYLE
ATPLTAFVVMSLSASGRADHEVTQNGLRFLRDSMLPDGSWPIDTNLANWATSLATTALTMDPD
DDRSWSTNELIQWQRGCQYQERHPFTGADPGGWGWTDLTGSVPDADDTPGAIISLRMQATT
RPDPLCDDYSRDWPASDSSGSVSANALDTWKACDRGVDWLLGLQNRDGGWPTFCRGWGKL
PFDRSSNDLTAHALRAIACLPKRESAKRSRAVQRGLRFLRKNQQADGSWLPLWFGNQDRPEE
DNPIYGTSRVLVDVSPALGHDAISRGLYYLINSQNSDGGWGGESVRETFGLPEGFISSVEETA
LAVEALVSWWGRIPGNEGGQAAENDIPDGSPWDASMRSALRAAILSGTRWLIDAVQRERHQV
AWPIGFYFAKLWYYERLYPLVYTTAALGRVMQRDELLR >seq_ID 247
MEIQDEVDLLEPQESLTASADSAVDRALFWLLDAQYEDGYWAGILESNACMEAEWLLCFHVLG
IANHPMSRGLVQGLLQRQRADGSWDVYYGARAGDINTTVEVYAALRCQGYAADHPDIKRARD
WIQLQGGVKQVRVFTRFWLALIGEWPWEETPNLPPEILFFPRWFPFNIYHFAAWARATLVPLCI
LSARRMVVPLNKKSCLQELFPEDRSAVVALGKKAGAWSTFFYHADRALKKYQRTFKRPPGRQ
QAIKMCLEWILRRQDADGAWGGIQPPWIYSLMALKAEGYPVTHPVMAKGLAALDAHWSYERP
GGARFVQACESPVWDTLLSSFALLDCGFSCTSSSELRKAVDWILDQQVLLPGDWQQKLPTVS
PGGWAFERANVHYPDVDDTAVALIVLAKVRPDYPDTARVNLAIERGLNWLFAMQCRNGGWGA
FDKDNDKDLLTKIPFSDFGETIDPASVDVTAHVLEALGLLGYRTTHPAVAKALEFIRSEQENDGC
WFGRWGVNYIYGTAAVLPALASLNMNMNQEFIRRAANWILGKQNNDGGWGESCASYMDDTQ
RGRGPSTASQTAWAMMSLLAVDGGTYAESLLRAEAYLKTTQTPEGTWDEPYYTGTGFPGYGI
GRREIKRQRSLQQHAELSRGFMINYNLYRHYFPLMALGRLAALRGA >seq_ID 148
MTSPFKHPISHALTSFNGIVTEPEQSVEQKAGAKVHQFPASLWKSKPGKAKSPLDIAIEGCRDF
FFREQLPKGYWWAELESNVTITAEYIMLFNFLSLVDHERQRKMSNYLLSKQTEEGFWTIYYGG
PGDLSTTVEAYFALKLTGYPADHPAMVKARAFILEKGGVIKSRVFTKIFLALFGEFDWLGVPSMP
VELNLLPNWAYVNVYEFSSWARATIIPLSIVMLKRPVHKLPPSQRVQELFVRPPRAIDYTFTKED
GIFTWKNFFIGLDHMLKVYERSPVRPFKKRAMGKAEEWVLEHQEETGDWGGIQPAMLNAVLA
LSALGYDNGHPAVAHGLKALENFCIESDEQIVLQSCISPVWDTALALKALVDAGVPSDHPSLVK
GAQWLLEREVRRPGDWRVKSPDLEPGGWAFEFLNDWYPDVDDSGFVMIALKGVEVKDRKAM
NAAVKRGIDWCLGMQSKNGGWGAFDKDNTRHILNKIPFADLEALIDPPTADLTGRMLELMGTF
GYAKTYPAAQRALKFLKENQEPEGPWWGRWGVNYLYGTWSVLCGLAAIGEDLEQPYIKKAVN
WIKSRQNMDGGWGETCESYHDPTLAGMGESTASQTGWALLGLMAAGEVHSATVVRGVQYLI
STQSQDGTWDETQYTGTGFPKYFMIKYHIYRNCFPLMALGTYRTLTGGTA >seq_ID 149
MTSPFKHPISNALTSFNGNFAEPEQCVEQQTGAKVHHLPASIWKRKMGKAKSPLDVAIEGSRD
FFFQEQLPKGYWWAELESNVTITAEYIMLFHFLGLVDRERQRKMSNYLLSKQTEEGFWPIYYG
GPGDLSTTIEAYFALKLSGYPADHPALAKARAFILEQGGVVKSRVFTKIFLALFGEFEWQGVPS
MPVELNLLPDWAYINIYEFSSWARATIVPLSVVMHSRPVRRVPPSARVQELFVRQPTAADYSFA -continued Enzyme Sequences KNDGIFTWENFFLGLDRVLKVYEKSPLRPFKNMALAKAEEWVLEHQEPTGDWGGIQPAMLNA
VLALNVLGYQNDHPAVEQGLRALANFCIETEDQLVLQSCVSPVWDTALALKALLDAGVPPDHP
SLVKGAQWLLDKEVTRPGDWRVKSPALEPGGWAFEFLNDWYPDVDDSGFVMIALKGIQVKDR
KSMDAAIKRGINWCLGMQSKNGGWGAFDKDNTRHVLNKIPFADLEALIDPPTADLTGRMLELM
GTFNYPITLPAAQRAIEFLKKNQEPEGPWWGRWGVNYLYGTWSVLCGLAAIGEDMDQPYIRKA
VNWIKSRQNIDGGWGETCQSYHDRTLAGVGESTPSQTGWALLGLLAAGEMHSATVVRGVQY
LISTQNSDGTWDEQQYTGTGFPKYFMIKYHIYRNCFPLMALGTYRTLTRTQP >seq_ID 216
MTDVLTRELSPNSTRDRVRSCVSSARQYLLSLQHEEGWWKGELDTNVTMEAEDLLLRQFLGIS
DEQVTQETARWIRSCQREDGTWATFHGGPPDLSTTVEAYVALRLAGDAMDAAHLRKAREYIL
DSGGIESTRVFTRIWLALFGEWPWSRLPVLPPEMMLLPDWFPLNIYDWASWARQTVVPLTIVG
SLRPTRDLGFSVRELRTGIQRRDLESPLSWAGVFHGLDSVLHRLEKLPLKPLRKVALARAEQWI
LDRQESDGGWGGIQPPWVYSILALHLRGYPLDHPVLRKALDGLDGFTIRHRTENGWIRKLEAC
QSPVWDTALAMTALLDSGTPPNDPALVRAADWILRQEIRVSGDWRVRRPALEPSGWAFEFAN
DHYPDTDDTAEVVLGLQRVRHPEPHRVNAAVERATAWLVGMQSSDGGWGAFDADNTRTLCE
KLPFCDFGAVIDPPSADVTAHIVEMLAARGMADSESARRGVRWLLEHQEVDGSWFGRWGAN
HVYGTGAVVPALVACGISPQHEAVRAAVQWLVAHQNADGGWGEDLRSYVDRTWVGRGTSTP
SQTAWALLALLAAGERGEVVRRGVEWLMAAQRPDGGWDEPQYTGTGFPGDFYISYHMYRIV
FPLTALGRYLGRGGDVGTG >seq_ID 229
MTATTDGSTGASLRPLAASASDTDITIPAAAAGVPEAAARATRRATDFLLAKQDAEGWWKGDL
ETNVTMDAEDLLLRQFLGIQDEETTRAAALFIRGEQREDGTWATFYGGPGELSTTIEAYVALRL
AGDSPEAPHMARAAEWIRSRGGIASARVFTRIWLALFGWWKWDDLPELPPELIYHDTWVPLNI
YDFGCWARQTIVPLTIVSAKRPVRPAPFPLDELHTDPARPNPPRPLAPVASWDGAFQRIDKALH
AYRKVAPRRLRRAAMNSAARWIIERQENDGCWGGIQPPAVYSVIALYLLGYDLEHPVMRAGLE
SLDRFAVWREDGARMIEACQSPVWDTCLATIALADAGVPEDHPQLVKASDWMLGEQIVRPGD
WSVKRPGLPPGGWAFEFHNDNYPDIDDTAEVVLALRRVRHHDPERVEKAIGRGVRWNLGMQ
SKNGAWGAFDVDNTSAFPNRLPFCDFGEVIDPPSADVTAHVVEMLAVEGLAHDPRTRRGIQW
LLDAQEADGSWFGRWGVNYVYGTGSVIPALTAAGLPTSHPAIRRAVRWLESVQNEDGGWGE
DLRSYRYVREWSGRGASTASQTGWALMALLAAGERDSKAVERGVAWLAATQREDGSWDEP
YFTGTGFPWDFSINYNLYRQVFPLTALGRYVHGEPFAKKSRAADAPAEAAPAEVKGS >seq_ID 113
MTDVIDKAVAATGPADPSQGAAATLQAAADHLLGLQDDAGWWKGELETNVTMDAEDLLLRQF
LGIRTEEVTREAGDWIRSQQRADGTWANFFDGPADLSTTIEAYTALRMAGDAKDAEHMRAART
YILDSGGIEASRVFTRIWLALFGEWQWSDLPVMPPELIYLPKWFPLNVYDWACWARQTVVPLTI
VNALRPVRPLGFDLKELRTGRRAPAQRGLFSTLDRALHVYERKPLRSVRDAALRRSADWIIAR
QEADGSWGGIQPPWVYSLMALNLLGYGVDHPVMRKGIEGLDRFTIRDERGRRLEACQSPVW
DTVLAMTALRDAELPENHPALVKAADWVLGEEITNPGDWSVRRPRVAPGGWAFEFDNDGYPD
VDDTAEVVLALNRVAHPDAPAAIRRGVDWLEGMACKDGGYGAFDADNTRTLALKLPFCDFGA
VIDPPTADVTAHTLEAYAALGLANSRASQRALEWLVKAQERDGSWFGRWGANHVYGTGAVVP

Enzyme Sequences

AMVAVGVDPEDEMIRRAVRWLEEHQNDDGGWGEDLRSYRDKSWIGRGVSTASQTAWALLAL

LAAGEERGTAVEQGVRFLIRTQRADGTWDEDHYTGTGFPGDFYLNYHLYRLVFPISALGRYVR

AVGAAGDGGDAGHAGHAGTVS

>seq_ID 236
MTATTDGGGAITGGADPRHDSTAAPAAAAAGPSGGGTGLPEGVREAVDRATAELLARQDPAG

WWKGDLQTNVTMDAEDLLLRQFLGIRDEAVTRAAALFIRGEQQGDGTWATFHGGPPELSATIE

AYVALRLAGDPPDAPHMTRASAWIRAHGGIAAARVFTRIWLALFGWWSWDRLPELPPELVFLP

PWVPLNIYDFGCWARQTIVPLTVVSALRPVRSAPFALDELHTDARDPVPAKPLPPLASWDGAF

QRMDKALHLYRRVAPRRLRKAAMAAAGRWIVERQENDGCWGGIQPPAVYSVIALHLLGYDLG

HPVMRAGLESLDRFAVWREDGARMVEACQSPVWDTCLAAIALADAGLPPDHPALVRAADWM

LGEEIRRPGDWAVRRPGLAPGGWAFEFHNDNYPDIDDTAEVVLALRRIRHPQPGGVEAAIARG

VSWTLGMQSKNGAWGAFDADNTSPFPNRLPFCDFGEVIDPPSADVTAHVVEMLAAEGRAADP

RARRGIAWLLAEQEPDGPWFGRWGTNYVYGTGSVVPALTAAGIAPSHPAVRRAVRWLESVQ

NEDGGWGEDQRSYRDRSWAGKGASTASQTAWALMALLSAGERDGDAVARGLAYLVETQRP

DGTWDEPYFTGTGFPWDFSINYHLYRQVFPLTALGRYLHGEPFGPERRNVPPAGES

>seq_ID 134
MSLTSDPSPATPATQPTSARPGSLSDRRSRSGGSAVAGPVLVTTRPVAPVAKSGAVTPTATSG

AVTSTATSGPALLPDLATDLADPTGPLAGAASATVRAAGGAGTRTQQTGQLGSTELAGPQAD

QVADRAAAVLGRARDHLLGLQSEAGWWKGELETNVTMDAEDLMLRQFLGILPPELAAETGRW

IRSKQQDDGGWPTFHGGPSDLSTTFEAYVGLRLAGDLPDAPHMLAAASFVRAHGGLAATRVF

TRIWMALFGEWPWDEVPVLPPELVLLPSWVPLNVYDFGCWARQTVVALTIVGHFRPVRSLGF

SIDELRVAAVRPDRAPLVSWTGVFQRLDAGLRRYQRHPVKTLRELALRRATEWVLARQEADG

GWGGIQPPWVYSIMALHLMGYSMDHPVLVAALDGLETFTVREQVREGDEVVTVRRLEACQSP

VWDTALAVVALADAGLDARHPAMRKAGEWLVREEVTVPGDWRVRRPNLEPGGWAFEFANDI

YPDVDDTAEVVLAVRRLLGSGWDDVDPTFAKQARASVERAVNWSVGMRSANGAWGAFDAD

NVRELATKIPFCDFGEVIDPPSADVTAHMVEMLADLGRADHPVTQRAVRWLLDDQEPGGSWF

GRWGVNHVYGTGAVVPALISAGVAADHPAIRSAVRWLVAHQHPDGGWGEDLRSYQDDAWV

GRGEPTASQTAWALLALLAADPMNEAVGRGVRWLCDTQLPNGTWDEPYYTGTGFPWDFSIN

YHLYRLVFPLTALGRYVTLTGRSAA

>seq_ID 225
MTATTDGSTGAALPPRVTAASDTDTDIPVAAGVPDIAARAMRRATDFLLSRQSDQGWWKGDL

ETNVTMDAEDLLLRQFLGIRDEGTTRAAALFIRGEQREDGTWATFHGGPGDLSATIEAYVALRL

AGDPPDAPHLARASAWIREQGGIAASRVFTRIWLALFGWWKWEDLPELPPELIWFPAWVPLNI

YDFGCWARQTIVPLTIVSAERPVRPAPFPLDELHTDPARPNPPRALAPVTGWDGAFQRLDKAL

HVLRGAVPRRLRRAAMNTAARWIIERQENDGCWGGIQPPAVYSIIALHLLGYDLNHPVMRAGL

ESLDRFAVWREDGARMIEACQSPVWDTCLATIALADAGLPADHPQLVKAADWMLGEQIVRPG

DWSVRRPHLPPGGWAFEFHNDNYPDIDDTAEVVLALRRVAHHDPERVDNAIGRGVRWNLGM

QSRNGAWGAFDVDNTSPFPNRLPFCDFGEVIDPPSADVTAHVVEMLAAEGLAHDPRTRRGVQ

WLLAEQEPNGSWFGRWGVNYLYGTGSVVPALTAAGISGSHPAIRRAVAWLESVQNDDGGWG

EDLRSYRDARGWSGRGASTASQTAWALMALLAAGERESRAVERGVEWLAATQHEDGSWDE

Enzyme Sequences

PYFTGTGFPWDFSINYHLYRQVFPLTALGRYVNGEPLAGKPRAAGAATAREDTGQEQSLAEAK
GS

>seq_ID 223
MTATTDGSTGAANITGAPADDPTDTRTAANDVTDIARRAAERSVEHLLGRQDEQGWWKGDLA
TNVTMDAEDLLLRQFLGIQDPATTRAAALFIRGEQLGDGTWNTFYGGPGDLSATIEAYVALRLA
GDRPDEPHMARASGWIRDQGGIAAARVFTRIWLALFGWWKWDDLPELPPELMFFPKWVPLNI
YDFGCWARQTIVPLTIVSAKRPVRPAPFALDELHTDPDHPNPPRKLAPPTSWDGLFQRLDKGL
HLYHKVAPRPLRRIAMNVAARWIIERQENDGCWGGIQPPAVYSVIALHLLGYDLDHPVMKAGLA
SLDRFAVHREDGARMIEACQSPVWDTCLATIALADAGLRPDHPALVKAADWMLAEEITRPGDW
SVRKPELAPGGWAFEFHNDNYPDIDDTAEVVLALRRVRHPDPARLEAAIARGVRWNLGMQSR
NGAWGAFDADNTSPFPNRLPFCDFGEVIDPPSADVTGHVVEMLAVEGLANHPRTREGIEWLLA
EQEACGAWFGRWGVNYVYGTGSVVPALITAGLPAGHPAIRRAVDWLESVQNDDGGWGEDLR
SYQEEKWIGHGESTASQTAWALLALLAAGRRDTASVTRGVTWLTEAQQADGSWDEPYFTGT
GFPWDFSINYHLYRQVFPLTALGRYVHGDPFADRTDAAEGV >seq_ID 226
MTATTDGSTGAALPPRVTAASENDTDIPEAAGVPDIAAHAMRRATDFLLSRQDDQGWWKGDL
ETNVTMDAEDLLLRQFLGIRDEDTTRAAALFIRGEQREDGTWATFHGGPGELSTTIEAYVALRL
AGDPPEAPHMARASAWIRERGGIAAARVFTRIWLALFGWWKWEDLPELPPELIWFPSWVPLNI
YDFGCWARQTIVPLTIVSAKRPVRPAPFPLDELHTDPRRPRPPRPHAPPNTWDGAFQRLDRAL
HALRRAVPRRVRQAAMNAAARWIIERQENDGCWGGIQPPAVYSVIALHLLGYDLRHPVMRAGL
ESLDRFAVWREDGARMIEACQSPVWDTCLAAIALADAGLPADHPSLVKAADWMLGEQIVRPG
DWSVRRPHLPPGGWAFEFHNDNYPDIDDTAEVVLALRRVRHHDPERMDSAIGRGVRWSLGM
QSKNGAWGAFDVDNTSPFPNRLPFCDFGEVIDPPSADVTAHVVEMLAVEGLAHDPRTRRGIQ
WLLAEQEPDGSWFGRWGVNYLYGTGSVVPALAAAGIPGSHPAIRRAVAWLEKVQNDDGGWG
EDLRSYRHVREWSGRGASTASQTAWALMALLAAGERDSGAVERGVAWLAATQREDGSWDE
PYFTGTGFPWDFSINYHLYRQVFPLTALGRYVHGEPFSKKQTAARNGSAQPLAGVKGSR >seq_ID 219
MDPALSRAVDWLLEHQDPAGWWCGEFETNVTITAEHILLLRFLGLDPSPLRDAVTRYLLGQQR
EDGSWALYYEGPADLSTSIEAYAALKVLGLDPTSEPMRRALQVIHDLGGVAQARVFTRIWLAMF
GQYPWDGVPSMPPELIWLPPSAPFNLYDFACWARATITPLLIILARRPVRPLGCDLGELVLPGS
EHLLTRVPSGPFWWGDKVLKRYDHLVRHPGRDRACQRIVEWIIARQEADGSWGGIQSAWV
MSLIALHLEGLPLDHPVMRAGLAGFDRVALEDERGWRLQASTSPVWDTAWAVLALRRAGLPR
EHPRLALAVDWLLQEQIPGGGDWQVRTGTIPGGGWAFEFDNDHYPDIDDTAVVVLALLEAGH
EDRVRNAVERAARWILAMRSTDGGWGAFDRDNAREVIHRLPIADFGTLIDPPSEDVTAHVLEM
LARLSFPSTDPVVARGLEFLQQTQRPDGAWFGRWGVNYIYGTWCAVSALTAFADTDATARAM
VPRAVAWLLDRQNADGGWGETCGSYEDPNLAGVGRSTPSQTAWAVLALQAAGLGQHPACR
RGLDFLRERQVGGTWEEREHTGTGFPGDFFINYHLYRHVFPTMALAGAATGMDSPR >seq_ID 220
FLGIRDEATTRSAALFIRGEQREDGTWATFHGGPPDLSTTVEAYVALRLAGDSPDAPHMTRAA
HWVRSQGGIAEARVFTRIWLALFGWWPWDRLPELPPELIFLPPWAPLNIYDFGCWARQTIVPL
TVVSAKRPVRPAPFPLDELHTDPADPAPRARFAPLASWNGAFQRLDRALHAYRKVAPRALRRA

| Enzyme Sequences |
|---|
| AMATAGRWIVERQENDGCWGGIQPPAVYSMIALHLLGYDLGHPVMRAGLESLDRFTLTREDG |
| SRMVEACQSPVWDTCLATIALADAGVPADHPQLVRAADWMLDEQIERPGDWSVRRPHLAPG |
| GWAFEFHNDNYPDIDDTAEVVLALRRVRHPDTARMERAISLGVRWNLGMQSKNGAWGAFDV |
| DNTSSLPNRLPFCDFGEVVDPPSADVTAHVVEMLAAEGLAADPRTRRAVDWLLAEQEPSGAW |
| FGRWGVNYLYGTGSAVPALVDAGLPTTHPAIRRAVAWLESVQNDDGGWGEDLRSYREQGRM |
| ARGASTASQTGWALMALLAAGERESRAARRGVTFLAETQHEDGSWEEPYYTGTGFPWDFSIN |
| YHLYRQVFPLTALGRYTRGAAPEGA |
| >seq_ID 125 |
| MQTQNRVTSTQKVELSNLTQAIIASQNYILSRQYPEGYWWGELESNITLTAETVLLHKIWKTDKT |
| RPFHKVETYLRRQQNEQGGWELFYGDGGELSTSVEAYMALRLLGVTPEDPALIRAKDFILSKG |
| GISKTRIFTKFHLALIGCYDWKGIPSIPPWIMLFPDNFPFTIYEMSSWARESTVPLLIVFDKKPIFEI |
| EPAFNLDELYAEGVENVKYALPRNHNWSDIFLGLDKLFKWTEKNNLVPFHKKSLQAAEKWMLN |
| HQQESGDWGGIMPPMVNSLIAFKVLNYDVADPSVQRGFEAIDRFSIEEEDTYRVQACVSPVWD |
| TAWVIRALVDSGLKPDHPSLVKAGEWLLDKQILEYGDWAIKNKQGKPGGWAFEFINRFYPDLD |
| DSAVVVMALNGIKLPDENRKKAAINRCLEWMATMQCKPGGWAAFDVDNDQAWINEIPYGDLK |
| AMIDPNTADVTARVLEMVGSCGLKMDENRVQKALFYLEKEQESDGSWFGRWGVNYIYGTSGV |
| LSALAVIAPNTHKPQMEKAVNWLISCQNEDGGWGETCWSYNDSSLKGTGISTASQTAWAIIGL |
| LDAGEALETLATDAIKRGIDYLLATQTPDGTWEEAEFTGTGFPCHFYIRYHLYRHYFPLIALGRY |
| WKIGLKTPSVIPLN |
| >seq_ID 228 |
| MLARRATDRAVRHLLSRQDEQGWWKGDLETNVTMDAEDLMLRHFLGIQNPDVLDAAGRYIRS |
| QQAADGTWATFHGGPPELSATVEAYVALRLAGDPPDAPHMAAASAWVRNNGGVASSRVFTRI |
| WLALFGWWRWEDLPELPPEIIYFPPWLPLNLYDFGCWARQTIVPLTVVSAKRPVRPAPFSLDE |
| LHADPRRPNPPRPAAPLASWDGAFQRLDRALHLYRKVALRPLRRAALRSCARWIVERQENDG |
| CWGGIQPPAVYSVIALHLLGYDLDHPVMRAGLESLDRFAVWREDGSRMIEACQSPVWDTCLA |
| VIALADAGLAPDHPALVKSADWMLAEEIDRPGDWSVKRPRLAPGGWAFEFDNDNYPDIDDTAE |
| VILALRRVDHPRPERIAAAVRRGVRWTLGMQSRNGAWGAFDVDNTSPLPNRLPFCDFGEVIDP |
| PSADVTAHVVEMLAHEGGARDPRTRRAVGWLLAEQEPSGAWFGRWGTNYVYGTGSVVPALV |
| AAGLPATHPAIRRAVRWLESVQNEDGGWGEDQRSYPDPEWIGHGASTASQTAWALLALLAAG |
| ERESKAVERGVGWLAATQDQDGSWDEPYFTGTGFPWDFSINYHLYRLVFPLTALGRYVSGEA |
| TGARPRRT |
| >seq_ID 241 |
| MTATTDGSTGALPPRADAASEHDIETPEAAGVREAAVRAARRATDFLLSRQDAQGWWKGDLE |
| TNVTMDAEDLMLRQFLGVLDEKTAQAAALFIRGEQREDGTWASFYGGPGELSTTIEAYVALRL |
| AGDAPDSPHLAKASAWIREQGGIAAARVFTRIWLALFGWWKWEDLPELPPELIWFPKWVPLNI |
| YDFGCWARQTIVPLTIVSAKRPVRPAPFPLDELHTDPARPNPPRPLAPAFSWDGAFQRMDKGL |
| HALRKVAPRGLRRAMANAAARWIIERQENDGCWGGIQPPAVYSIIALHLLGYDLQHPVMREGL |
| ASLDRFAVWREDGARMVEACQSPVWDTCLAAIALVDAGLPADHPQLVKAADWMLGEEIVRPG |
| DWSVRRPGLPPGGWAFEFHNDNYPDIDDTAEVILALRRITHHDPVRVDKAVGRGVRWTLGMQ |
| SKNGAWAAFDVDNTSPFPNRLPFCDFGEVIDPPSADVTAHVIEMLAVEGLAHDPRTRRGIEWL |

| Enzyme Sequences |
|---|
| LAEQEPDGSWFGRWGVNYVYGTGSVVPALVAAGLPGAHPAIRRAVSWLESVQNDDGGWGE |
| DLRSYKYVKEWSGRGASTASQTAWALMALLAAGERDSKAVERGVEWLAATQREDGSWDEPY |
| FTGTGFPWDFSINYHLYRQVFPLTALGRYVHGEPFADRLKGS |
| >seq_ID 238<br>MHEGEAMTATTDGSTGAATPPATTASAPLHLSPEARETHEATARATRRAVDFLLARQSDEGW |
| WKGDLATNVTMDAEDLLLRQFLGIRDEATTRAAALFIRGEQQEDGTWNTFYGGPGDLSATIEG |
| YVALRLAGDSPEAPHMRKASAFVRAQGGVARARVFTRIWLALFGWWKWEDLPEMPPELMFF |
| PKWAPLNIYDFGCWARQTIVPLTVVCAQRPVRPAPFALEELHTDPADPDPAQPAPPVVSWDNV |
| FHKLDKLLHGYRRIAPRRVREAAMRAAATWIVERQENDGCWGGIQPPAVYSIMALNLLGYDLD |
| HPVLRAGLASLDRFAVWREDGARMIEACQSPVWDTCLATVALADAGVPADHPQMIKAADWML |
| AEQIVRPGDWVVRRPDLPPGGWAFEFHNDNYPDIDDTAEVVLALRRVAHPDATRVDKAVRRA |
| VDWNVGMQSKNGAWGAFDADNTSPFPNRLPFSDFGEVIDPPSADVTAHVVEMLAEEGLAHH |
| PRTRRGIEWLLKNQEGNGSWFGRWGVNYVYGTGAVVPALVAAGLPASHPAIRRSVSWLGQV |
| QNEDGGWGEDLRSYQDSAWHGRGHSTASQTAWALLALLAAGERETEQVRRGIAYLVETQTE |
| DGTWDEPWFTGTGFPWDFTINYHLYRQVFPVTALGRYLNGTGPGEN |
| >seq_ID 237<br>MRRRSPRGPGAGPEADYGPARASAPDRLRGDAARGDAARRVQDATARAIRNLLGRQDPAG |
| WWKGDLETNVTMDAEDLLLRQFLGIRDEAVTQAAALFIRREQREDGTWATFHGGPPELSATIE |
| AYVALRLAGDAPDAPHMATASAWIRAHGGLAAARVFTRIWLALFGWWDWENLPELPPELVLLP |
| PWVPLNIYDFGCWARQTIVPLTVVSAMRPVRPAPFALDELHTDARVPVPPRRMAPPTTWNGA |
| FQWMDRALHVYRRFAPRRLREAAMASAGRWIIERQENDGCWGGIQPPAVYSVIALHLLGYDL |
| GHPVMRAGLESLDRFAVWREDGSRMIEACQSPVWDTCLAAIALADAGVRPDHPALVKAADW |
| MLGEEIVRTGDWAVRRPGLAPGGWAFEFHNDTYPDIDDTAEVVLALRRIRHPDPARVEAAIAR |
| GVSWNLGMQSRGGAWGAFDADNTSPFPNRLPFCDFGEVIDPPSADVTAHVVEMLAAEGRAA |
| DPRTRRGIAWLLAEQEPEGPWFGRWGTNYVYGTGSVVPALTAAGLSPGHPAIRRAVLWLESV |
| QNPDGGWGEDQRSYQDRAWAGKGESTPSQTAWALMALLSAGERDAKTVERGIAYLVETQLA |
| DGGWDEPHFTGTGFPWDFSINYHLYRHVFPLTALGRYLYGEPFGHDGRHIGAHLGDRTGVPA |
| EGV |
| >seq_ID 239<br>MDFLLDRQSDEGWWKGDLATNVTMDAEDLLLRQFLGIRDEATTQAAALFIRGEQQEDGTWNT |
| FYGGPGDLSATIEGYVALRLAGDSPEAPHMRKASAFVRARGGVARARVFTRIWLALFGWWKW |
| EDLPEMPPELMFFPKWAPLNIYDFGCWARQTIVPLTVVCAQRPVRPAPFALEELHTDPADPNP |
| AQPAPPVASWDNVFHKLDKMLHGYRKVAPRRVREAAMRAAATWIVERQENDGCWGGIQPPA |
| VYSIIALHLLGYDLDHPVLRAGLESLDRFAVWREDGARMIEACQSPVWDTCLATVALADAGVPA |
| DHPQMIRAADWMLAEQIVRPGDWVVRRPDLPPGGWAFEFHNDNYPDIDDTAEVVLALRRVAH |
| PDATRVDKAVRRAVDWNAGMQSKNGAWGAFDADNTSPFPNRLPFSDFGEVIDPPSADVTAH |
| VVEMLAEEGLAHHPRTRRGIEWLLENQEANGSWFGRWGVNYVYGTGAVVPALVAAGIPAAHP |
| AIRRSVSWLGQVQNEDGGWGEDLRSYQDTAWHGRGHSTASQTAWALLALLAAGERDSEQV |
| RRGIAYLVETQTEDGTWDEPWFTGTGFPWDFTINYHLYRQVFPVTALGR |

| Enzyme Sequences |
| --- |

>seq_ID 235
MTQTVPRTAASAPAARTAADTVAAAVQFLRREQDRAGWWKGELATNVTMDAEDLLLRHFLGI

LTPQIAEESARWIRSQQRADGTWANFPDGPADLSTTVEAWVALRLAGDPADAPWLATAAEWI

REHGGIEATRVFTRIWLAMVGQWSWDDLPSLPPELIFLPSWFPLNVYDFACWARQTIVPLTIVG

TLRPARKLPFDVAELRTGKRPPKPRAPWTWDGVFQNLDTALHAYAKLPLNPVRKLALKQAAE

WILARQEADGSWGGIQPPWVYSILALHLLGYSLDHPALKAGIAGLDGFTIREKTDQGWVRRLEA

CQSPVWDTALAMTALLDAGVSPGDESLVRAAEWMLGEEIRVPGDWAVRRPSLKPGGFAFEFA

NDGYPDTDDTAEVVLALRRMGKPDHLRIREAVDRSVAWLEGMQSSDGGWGAFDADNTQVLT

TRLPFCDFGAVIDPPSADVTAHVVEMLAAEGKADTRECRRGIRWLWDNQEADGSWFGRWGA

NYVYGTGAVVPALVAAGVPGTDPRIRRAVRWLAEHQNDDGGWGEDLRSYDDRSWAGRGDS

TPSQTAWALLALLAAGERESTVVARGVEWLCERQRPDGGWDEDKHTGTGFPGDFYLSYHLY

RVVFPLSALGRYVRGGS

>seq_ID 159
MSGQSNFTGGKKMTPAEGSSSPAPALLEKAAPSIELDERSDPLSRTLARAVSWLVAAQDGAG

HWVAPLEADATIPSEYVFLHEVLGRPLDPVRRDKIVRAILSVQGKEGAWPLFHDGDPDISATVK

AYQALKLCGFDPSHPALVRAREWVLSQGGAGKVNVFTRIALAIFGQYSWTKIPALPAEMVLLPS

WFPFSIYSVSYWSRTVIVPLLFIYHHKPLVRLSPERGISELFDPARPDGESFAPSPDFFSLRNLFL

LLDKVLQVWNRHPPGFLRKKALSFAMEWMVPRLKGEGGLGAIYPAMANSAVALSLEGYELDH

PLMQRVLASIDDLLIEGEKEVLVQPCVSPVWDTALAMGALIEAGISPDSPTVDRAMEWFCAREV

RTRGDWAIRAPDCEPGGWAFQFENDYYPDVDDTAMVLMGMAKILPARPDLAARMEGVFRRA

TLWVMAMQGTDGGWGAFDRDNDLLFLNHIPFADHGALLDPSTADLTGRVLELLGALGYGPDF

PPAARAIRYLRREQEEDGSWFGRWGVNYIYGTWSVVAGLKSIGVPMSEPWVMRSMEFLLAR

QNPDGGWGEDCLSYASRDFAGRGASTPSQTAWALIALLHGGHAGHMAVRQGVDYLIQQMTP

EGTWNEELFTGTGFPRVFYLRYHMYRHYFPLWALALYRNMTERGRALGHERVDFWKTAPYA

PIARSV

>seq_ID 232
MTATTDGSTGALPPRAPSASDTDHGTPVAAGVQEAALHAVGRATDFLLSRQDAQGWWKGDL

ETNVTMDAEDLLLRQFLGIRDDATTRAAALFIRGEQRPDGTWATFYGGPPDLSATVEAYVALRL

AGDDPAAPHMAKASAWIRAGGIAAARVFTRIWLALFGWWKWDDLPEMPPEIVYFPTWMPLNI

YDFGCWARQTIVPLTVVSAKRPVRPAPFPLDELHTDPGRPNPPRPLDRLGSWEGAFQRLDRA

LHGYHKVALKRLRRAAMNRAARWIVERQENDGCWGGIQPPAVYSIALHLLGYDLGHPVMRA

GLESLDRFAVWREDGARMIEACQSPVWDTCLATIALADAGLPPDHPQLVKAADWMLGEEIVRP

GDWSVKRPQLPPGGWAFEFHNDNYPDIDDTAEVVLALRRVRHPDPERVERAVRRGVRWTLG

MQSGNGAWAAFDADNTSPFPNRLPFCDFGEVIDPPSADVTAHVVEMLAAEGLSHDPRTRRGI

EWLLAEQEPGGAWFGRWGVNYVYGTGSVVPALVTAGLPAAHPAIRRAVAWLETVQNDDGG

WGEDLRSYPDAEWGGKGASTASQTAWALLALLAAGERDGKATERGVAWLARTQREDGSW

DEPYFTGTGFPWDFSINYHLYRQVFPLTALGRYVHGEPAVLKPGTR

>seq_ID 224
MTATTDGSTGAANLRAAAASDPTESTSAAPDMMAVARHAAERSVEHLLGRQDEQGWWKGDL

ATNVTMDAEDLLLRQFLGIQDPETVKAAARFIRGEQLGDTWNTFYEGPPDLSATVEAYVALRL

AGDRPDDPHMIRAAGWVREQGGIAESRVFTRIWLALFGWWKWDDLPELPPELMFFPKWVPL

Enzyme Sequences

NIYDFGCWARQTIVPLTIVSAKRPVRPAPFALDELHTDPACPNPSRPTAPAASWDGVFQRLDKA

LHLYHKVAPRRLRRIAMNEAARWIIERQENDGCWGGIQPPAVYSVIALHLLGYDLDHPVMRAGL

ESLDRFAVWREDGARMIEACQSPVWDTCLATIALADAGVSPDHPALVRAADWMLGEEIVRPG

DWAVRKPGLAPGGWAFEFHNVNYPDIDDTAEVALALRRVRHPDPARVDAAIERGVRWNLGM

QSRNGAWGAFDADNTSPFPNRLPFCDFGEVIDPPSADVTGHVVEMLAVEGRAHDPRTRRGV

EWLLAEQEASGAWFGRWGVNYIYGTGSVVPALIAAGLPAAHPSVRRAVDWLRSVQNDDGGW

GEDLRSYREEKWIGHGSSTASQTGWALLALLAAGERETRSVERGVAWLAATQQADGSWDEP

HFTGTGFPWDFSINYHLYRQVFPLTALGRYVYGDPFATATAIGAGTGKGA

>seq_ID 243
MSISALQTDRLSQTLTQSVVAAQQHLLSIQNPEGYWWANLESNASITAEVVLLHKIWGTLDSQP

LAKLENYLRAQQKTHGGWELYWNDGGELSTSVEAYMGLRLLGVPASDPALVKAKQFILHRGG

VSKTRIFTKFHLALIGCYRWQGLPSLPAWVMQLESPFPFSIYELSSWARGSTVPLLIVFDKKPVY

PLQPSPTLDELFTESAENVRWELEEKGDWSDAFLWLDKAFKLAESVDLVPFREESIRKAEKWV

LERQEPSGDWGGIIPAMLNSMLALRALGYSVSDPVVRRGFQAIDNFMVESETECWAQPCISPV

WDTGLAVRSLTDSGLSPNHPALVKAGEWLLDKQILSYGDWSVKNPQGQPGGWAFEFENSFY

PDVDDTAVVAMALQDITLPNEPLKRRAIARAVRWIATMQCKTGGWAAFDINNDQDWLNDIPYG

DLRAMIDPSTADITGRVLEMHGRFAADLDLANSYAADLSPYRLSRGLNYLIKEQELDGSWFGR

WGVNYIYGTGQALSALALIAPERCRIQIERGIAWFVSVQNADGGWGETCESYKDKSLKGKGIST

ASQTAWALLGLLDVSFCLDPAAKIAVDRGIQYLVSTQSEGTWQEESFTGTGFPQHFYLRYRLY

CHYFPLMALGRYQRVINSSAGI

>seq_ID 197
MTSGTFGAKRVDLLAAFEHSAPAEKTRETCVGLQTAIARTRQYLLDQQHSEGFFVAELEGDTIL

ESEYILLLAFLNEGQSPDAQAAARYLLTKQNTDGSWSNFPGGPIDVSCAVKAYLALRITGHAAD

EPALIRAREAILQAGGVERVNSFTRFYLAMLGLIPYSLCPAVPPEVVLLPDWFPINLSQMSAWSR

TIVVPLSLLWAFQPAVELNDADGHQITIEELYASPEKQLPRFIRGVNHESNSNGWMNWSRFFFR

VDQCLKSIESYGIKPLRSRAVRKCVQWILDRQEMSDGLGAIFPPIVWTLIGLKCAGFDDQHPMV

QKQRDELNRLMLREQDALRLQPCLSPVWDTAISIIALRESGVEPDHPALSKARNWLLSKEVRHA

GDWSKAHPETPVSGWYFEFNNEFYPDVDDTAMVLIALASTLPEEATPLAISHGVLPVQTGWSA

ESTSRVQALKQLENHRPVLEAMGRGVQWLKALQSKDGGWGAFDSDINKELLTKVPFADHNAM

LDETNADISARVLEAYAAVGISFNDPSVQRALEFIWNDQEDDHAWYGRWGVNYIYGTWQVLV

GLTAIGISAHDPRLVRAAGWLKSKQQACGGWGETPATYDNPTLRGQGTPTASQTAWAVLGLIA

AGEQNSIECQRGVEFLLKTQKHNGTWDEEEFTGTGFPRVFYLRYHYYPLYFPLMALGRFARA

GGRVNFAG

>seq_ID 158
MTTNAAATSARSGEDAIRQVSGQQLETAIASARNSLLALQRPDGHFVFELEADATIPAEYVLMR

HYLAERVDAVLEEKIARYLRRIQSDDGGWPLFRDGASNISASVKAYYALKMIGDAPNAPHMQKA

RAWILAQGGASHSNVFTRNLLALFGAIPWSGVPVMPVEIMLLPKWFPFHIDKISYWARTVLIPLT

VLNALKPVARNPKGVGIAELFVTPPDQVRNWPKGPHQKFPWSQVFGGIDRVLRLFEPAFPKSL

RKKSIDKAVAFATERLNGEDGLGGIFPAMVNALLVYDALGYPHDHPDYVTARGSIEKLLVIKDDE

AYCQPCLSPVWDTALAVHALMESGVAQADQNVDRALAWLKPLQVLDTVGDWAASRPGVRPG

Enzyme Sequences

GWAFQYANAYYPDVDDTAVVVMAMDRAAGGDAAKRDHYRESMARGREWVAGVQSKNGGW

GAFDADNTYEYLNQIPFSDHGALLDPPTADVSARCVSMLAQLGERRETSPVLDKAMRYLESTQ

EKDGSWYGRWGMNYIYGTWSVLCALNAAGVAPSAPSMRKAADWLLSIQNSDGGWGEDGES

YSLDYKGYEPAPSTASQTAWALMGLMAAGEVDHPAVQRGVAYLAAKQGSDGFWGEERFTAT

GFPRVFYLRYHGYSKFFPLWALARYRNLNAANSKSVLVGM

>seq_ID 77
MAADGSALSESRLSSEALDRAVLSAHTALSQAQQDDGHWVYELEADATIPAEYILLEHFMDRID

DALEQKIAIYLRRIQSEEHGGWPLYHNGKFDLSATVKAYFALKAVGDDINAPHMQRAREAILDH

GGAERSNVFTRSQLALFGEVPWRATPVMPVELMLLPAKAFFSVWNMSYWSRTVIAPLLVLAAL

RPVAANPRQVHVRELFVTPPEKVQDWIRGPYRSAWGYVFKGLDSVLRPVVPFIPEKTHKKAIQ

AALDFIEPRLNGKDGLGAIYPAMANVVMMYRAMGVPDEDPRAKTAWEAVQALIVEKDDEAYC

QPCVSPIWDTGLSGHAMIEAASGPNGIAPEKTVAELKKASAWLRSKQILNVKGDWAVRNPNLA

PGGWAFQYGNDYYPDVDDTAVVGMLLHREGDPTNAEAIERARTWIVGMQSTDGGWGAFDID

NNKDVLNHIPFADHGALLDPPTADVTARCISFLAQLRNPEDEPVIQRGLEYLRKEQEKDGSWFG

RWGTNYIYGTWSALCALNAAGVSHDDPAVVKAVEWLRSVQRADGGWGEGCESYEGGPHGT

YGESLPSQTAWAVLGLMAAGRRDDPAVTRGIAWLADQQDANGEWHEDPYNAVGFPKVFYLR

YHGYKQFFPLMALARYRNLESSNTRRVSFGF

>seq_ID 6
MTVSTSSAFHHSSLSDDVEPIIQKATRALLEKQHQDGHWVFELEADATIPAEYILLKHYLGEPED

LEIEAKIGRYLRRIQGEHGGWSLFYGGDLDLSATVKAYFALKMIGDSPDAPHMLRARNEILARG

GAMRANVFTRIQLALFGAMSWEHVPQMPVELMLMPEWFPVHINKMAYWARTVLVPLLVLQAL

KPVARNRRGILVDELFVPDVLPTLQESGDPIWRRFFSALDKVLHKVEPYWPKNMRAKAIHSCV

HFVTERLNGEDGLGAIYPAIANSVMMYDALGYPENHPERAIARRAVEKLMVLDGTEDQGDKEV

YCQPCLSPIWDTALVAHAMLEVGGDEAEKSAISALSWLKPQQILDVKGDWAWRRPDLRPGGW

AFQYRNDYYPDVDDTAVVTMAMDRAAKLSDLHDDFEESKARAMEWTIGMQSDNGGWGAFDA

NNSYTYLNNIPFADHGALLDPPTVDVSARCVSMMAQAGISITDPKMKAAVDYLLKEQEEDGSW

FGRWGVNYIYGTWSALCALNVAALPHDHLAIQKAVAWLKNIQNEDGGWGENCDSYALDYSGY

EPMDSTASQTAWALLGLMAVGEANSEAVTKGINWLAQNQDEEGLWKEDYYSGGGFPRVFYL

RYHGYSKYFPLWALARYRNLKKANQPIVHYGM

>seq_ID 89
MNDLTNSSAPGARPDDATPSAAGPTPAEAAGGAVAPSRAVQPADTQTAATGAAGAAAAVGAT

PAELAATAPASSGTPAGASAAPAPSGTPSVDAPAELASAAPAPSGATPAATATAATAPAPARA

ASIDAPALAAADLDAAITRATDALLAAQQADGHWIYELEADSTIPAEYVLLVHYLGETPNLELERK

IARYLRRVQLPGGGWPLFTDGAPDVSASVKAYFALKMIGDDANAEHMVRARNAIHAMGGAEM

SNVFTRIQLALFGVVPWFAVPMMPVEIMLLPQWFPFHLSKVSYWARTVTVPLLVLSAKRPLARN

PRGVRVDELFVAPPVNAGLLPRAGHQSPAWFACFRLLDGLLRLTDGLFPRYTRERAIRQALQF

VDERLNGEDGLGAIYPAMANSVMMYAALGYPEDHPNRATARRAIEKLLVIHDDEAYCQPCLSP

VWDTSLAAHALLETGEPRAEAAAIRGLDWLRPLQILDVRGDWISRRPDVRPGGWAFQYANPH

YPDVDDTAVVTLAMDRVAKLAQTDAYRDAIARAREWVVGMQSSDGGWGAFEPENTHQYLNSI

PFSDHGALLDPPTADVSGRCLSMLAQLGETAANSAPARRALDYLLAEQGADGSWYGRWGMN

| Enzyme Sequences |
| --- |
| YIYGTWSALGALNAAGLPFDDPRVKRAAQWLLSIQNPDGGWGEDGDSYKLDYRGYERAASTA |
| SQTAWALLGLMAAGEVEHPAVARGIAWLAAQQREHGLWDEARFTATGFPRVFYLRYHGYRKF |
| FPLWALARYRNLRRTGTRRVTVGM |
| >seq_ID 201<br>MLPYNQNSYKEALHGGHAAHNPPTLEEAIKRSQEFLLAHQHPEGFWWGDLECNVTSASHTLIL |
| YKILGIADRYPLHKFEKYLRRMQCSHGGWEMSFGDGGYLSATIEAYICLRLLNVPQSDPALQRA |
| LKNILARGGVTKARVFTKVCLALLGGFDWAALPSLPPWLMLFPAWFPWNIYEAASWARGCVVP |
| LIVLLEKKPVFQVKPEVSFDELYVEGRAHACKALPFSAHDWVSNIFVAADRAFKLMERFGAVPF |
| RQWSIKEAKKWVLDRQEEMGDFIGYNPPMLYFAVCLKLWGYEVTDPLLQRALLAHKKLTVETE |
| DECWLQSSQSPVWDTALVIPALVESGLPPDHPALQKAGQWLLEKQILKHGDWALKTGGGRMQ |
| DDIGGGWAFQFVNSWYPDVDDSAAVVIALNCIKMPDEDVKNGAIARCLKWIAFMQGRNGGWA |
| AFDRDSNQRWMDATPFSDIEAMLDVSTADVTARVLEMVGLMRLKHAAQPANNSLGKAHRHIS |
| TESIARGVDYLTKEQEKEGCWWGRWGVNYIYGTRGALMGLSQVAAKTHKKEIARGAAWLVKV |
| QNKKNEKKQGAQDGGWGEACFSYDDPATKGQNSRSTASQTGWAMQGLLAAGEVLGRKYEM |
| EAVEEGVQFLLDTQRKDGSWSEAEFTGGGFPKHYYLKYHYFAQHFPLSALARYRARLLQLSR |
| PKNQA |
| >seq_ID 183<br>MDGSQRISDMSQQPEGIAVSDEISSAYSVSSLNQDEINVDELENKLTQARSAMLSLQKPDGHW |
| CFPLEADCTIPAEYILMMHFMDEIDVILENKIARFIREKQDLTHGGWPLYYGGAFDISCTIKSYYA |
| LKLVGDSPDAAHMVRAREAILERGGAAKANVFTRLLLAMYEQIPWSGVPVVPTELMLLPSWFP |
| FHISKVSYWSRTVMIPLSILCTIKARAINPRNVIDIRELFIVPPEQEKNYFPQADTWLKRAFMLVER |
| VLSRVEPKLPQAIRQYSIRKAENWTLERLNGECGIGAIFPAMVNAHESLALLGYAYDHPSRVQC |
| RNALRGLLVDEGERAWCQPCTSPVWDTVLTCLALQEDPAADQGPVLKALDWLVDQQVLDEP |
| GDWRDKRPDLLGGGWAFQYANPHYPDLDDTAAVAWALDQSDAQRYQKPLDRAANWLAGMQ |
| SRNGGFAAFDIDNTYHYLNEIPFADHGALIDPPTSDVTARCVGLLGKYGKHQREVWRGISFLLR |
| EQEKNGSWFGRWGTNYIYGTWSVLEAFQLANFDMQHTSVRRAVKWLESVQRVDGGWGETN |
| DSYLDIQLAGQFPQTSTTFQTAWAVLGLMAAGEVNSKSVRRGINYLLHNQADDHLWEDPWFT |
| APGFPRVFYLRYHGYSKFFPIWALVRYRALTKERVS |
| >seq_ID 102<br>MNDLSQTQPLDAVLPEAADAASNLAEAAVVANAPAVADALATATPSPMQTAGASPLDVSITRA |
| TDAILAAQQPDGHWIYELEADATIPAEYVLLVHYLGETPNLELEQKIARYLRRIQLPNGGWPLFT |
| DGALDISASVKAYFALKMIGDPVDAEHMVRARDAILAHGGAEHANVFTRILLALFGVVSWRAVP |
| MMPVEIMLLPMWFPFHLSKVSYWARTVIVPLLVLNAKRPLARNPRKVRIDELFRGAPVNTGMN |
| ERAPHQHAGWFGFFRCVDTVLRAVDGLLPKASRERAIRAAVAFVDERLNGEDGLGAIFPAMAN |
| SVMMYDVLGYPADHPNRAIARKSLDKLLVIKEDEAYCQPCLSPVWDTSLVAHALLETREARAE |
| QAAERGLAWLRPLQILDVRGDWISRRPNVRPGGWAFQYNNAHYPDVDDTAVVAMAMHRSAA |
| LTKSDVDREAIARAREWVVGMQSSEGGWGAFEPENTQYYLNNIPFSDHAALLDPPTADVSGR |
| CLSMFAQIGELPQNSEPAQRAFDYMLQEQESDGSWYGRWGLNYIYGTWTALCSLNAAGMSH |
| DDPRMRRAVQWLVSIQNEDGGWGEGGESYKLDYRGYERAPSTASQTAWALLGLMAAGEVD |

| Enzyme Sequences |
|---|
| HDAVARGIDYLQREQREHGLWDETRFTATGFPRVFYLRYHGYRKFFPLWALARFRHLKRNGL<br>TRVTVGM<br><br>>seq_ID 90<br>MIRPMKNSDLPLPSLLDAAILRGRDALAQRQSADGSWCFELESDATITAEYILMMHFMGKIDEA<br>RQARMARYLRGIQRLATHGAWDLYVDGAPDVSCSVKAYFALKAAGDSEDAPHMARARETILKL<br>GGAAKSNVFTRILLATFGQVPWRATPFMPVEFVLFPKWVPISMYKVAYWARTTMVPLLVLCSL<br>KARAKNPRNVSIRELFVTAPEAERHYFARGGFVRNLFLGIDRALRPLDALIPKALRRRAIRHAEA<br>WCAERMNGEDGMGGIFPPIVYSYQMMDVLGYPEDHPLRRDCENALDKLLVERPDGSVYCQP<br>CLSPVWDTAWSTMALEQARAVPDPRDAPPVSDAQLQRCIAASYEWLAGKQVTQVRGDWVEN<br>APAATPAGGWAFQYENPYYPDIDDSAVVAAMLHRRGRLLARSTGTDPYAQVVARGLDWMRG<br>LQSRNGGFGAFDADCDRLYLNLIPFADHGALLDPPTEDVSGRVLLCLGVTGRDEDKPALARAIE<br>YVKRMQRADGCWWGRWGTNYIYGTWSVLAGLALAGENPSQPYIARAIAWLRACQNADGGW<br>GETNDSYLDPALAGTNGGESASNVTAWALLAQMAFGDWQSESVQRGIRYLLSVQQADGFWW<br>HRSHNAPGFPRIYYLKYHGYTAYFPLWALARYRRLSQAGAARDVTDGAALAAS<br><br>>seq_ID 67<br>MREAAVSKVETLQRPKTRDVSLDDVERGVQSATRALTEMTQADGHICFELEADATIPSEYILFH<br>QFRGTEPRPGLEAKGNYLRRTQSKVHGGWALVHDGPFDMSASVKAYFALKMIGDDIEAPHM<br>RAVRKAILQRGGAANANVFTRILLALYGEVPWVAVPVMPVEVMHLPKWFPFHLDKVSYWARCT<br>MVPLFVIQAKKPRAKNPRGVGVAELFVTPPDSVRTWPGSPHATWPWTPIFGGIDRVLQKTQDH<br>FPKVPRQRAIDKAVAWVSERLNGEDGLGAIFPAMVNSVLMYEVLGYPPEHPQVKIALEAIEKLV<br>AEKEDEAYVQPCLSPVWDTALNSHAMLEAGGHQAEANARAGLDWLKPLQILDIKGDWAETKP<br>NVRPGGWAFQYANPHYPDLDDTAVVVMAMDRAQRQHGLVSGMPDYSESIARAREWVEGLQ<br>SADGGWAAFDADNNHHYLNHIPFSDHGALLDPPTADVTARVVSMLSQLGETRATSRALDRGV<br>TYLLNDQEKDGSWYGRWGMNFIYGTWSVLCALNAAGVDPQSPEIRKAVAWLIRIQNPDGGWG<br>EDASSYKLNPEFEPGYSTASQTAWALLALMAAGEVDDPAVARGVNYLVRTQGQDGLWSEER<br>YTATGFPRVFYLRYHGYPKFFPLWAMARFRNLKRGNSRQVQFGM<br><br>>seq_ID 133<br>MTTTDETALAAGTPKAAFAPAPRGAADDLVARTVAVEAPPSPAPASDDTLARAVAHLKSLQDE<br>AGWWKGDLETNTTMDSEDLMLRHWLGIWNPEQAERTARFIRSKQYADGSWPIYHAGPGDLN<br>ATVESYVALRMVGDSPQDPHMRAAAAWARARGGVPATRIFTRIWLALFGWWRWEDLPVLPP<br>ELIFVPAKMPLSIYKFASWGRQTIVAIMVLMAHRPAGTPPFPIAELFPPPATKKKAAAQRKAQKK<br>AGHAGGPTAWRDSSIDDMFTEPAPGTDTLRQPAALAIGPARPAPAKGRRGKGQPAAPDVMG<br>RAKDGGGPGLPLPARLVSRVGFRTRRALRQAALDHVNWNLLFGGIDRFLHVYHRHPIRPVRSL<br>ALGLAERWIVVRQEADGCFGGIQPPTVYSIMALRVLGYPMDHPVMTAALRSLDEYSVTLPDGA<br>RMQEACQSPVWDTCLATIALADAGVPRDDPSLVRAADWMLAEEVRERRGDWSVPIPDVPTG<br>GWSFEFDNDTYPDVDDSAEVMLALMRVAHPRPEKVVAATYRGLQWVFGMQCADGGWGAFD<br>VDNAGELVYKIPFADFGMLTDPPSADVTAHVVELLGELGLGDDPRTKRGVEWLLHSQEADGS<br>WYGRWGVNHLYGTGGVVPALRAAGLPASHPAIQRAADWLVAKQNPDGGWGESCYSYDEMS<br>TAGVGVSTASQTAWALLALIAAGRVGDGVTGEAAARGVAWLAETQTAEGTWDEDYFTGTGFA<br>GYFYINYHLYRLVWPVMALGRYQAALAGKGH |

Enzyme Sequences

>seq_ID 7
MNPVVHNLTRPHRSAEPRPSALQRSIAAAQAALLQHQAADGHWCFEFEADCTIPAEYILMMHY

MDERDAALEAKMAAYLRRKQENHGGWSLYHGGHFDMSASVKAYFALKLAGDDPEAAHMRRA

RSAILAHGGAERANVFTRITLALFGQVPWRAVPFIPVEILLFPRWFPMHIYKVASWSRTVMVPLF

ILCSLKPQAKNPLGVHIRELFTRPPEDIDDYFAHALQGWVSRIFLWFDRLGRALESWIPQALRRR

AIARAEAWFIERLNGEDGLNGIFPAMVNAHEALALLGYAAEHPYRQQTRAALTKLVVERAGEAY

CQPCVSPVWDTCLALHALLEADGDVSEAARRSMQWLLDRQITDAPGDWRERRPHLAGGGWA

FQYANPYYPDLDDTAAVAWALARARRPEDRPAVERAANWLAGMQSRNGGFGAYDVDNTYYY

LNEIPFADHKALLDPPTADVSGRVLAFLAILDREQDAPVRARLIQYLLREQEPSGAWFGRWGTN

YIYGTWSVLMGMAELRDPGAEVRDAMARAAHWLRSVQQDDGGWGESNDSYADPGLAGLGQ

ESTAAQTAWACLALMAAGDSDSESLRRGIQWLQRHQEQPGDWQDPYFNAPGFPRVFYLTYH

GYKIYFPLWALARYRNITERHCA

>seq_ID 190
MALSNGEIREEIQRLSEELIQRQEPDGSWRFCFENGITIDACTIILLRTLNVDKEELIRQLHDRIVA

AQQPEGCWRWYHDDKEGHLSATVEAYYALLCSGYSRPEDEPIQRAKRYILDRGGIGQARSLF

TKAILAATGQRKWPASLSLIPIEILLLPESLPLNFYDFSGYSRVHLVPLLIMAERNFRTRSVRTPDL

SELFLDARNGEEDPLTLTPESREPLKLIQSGLAHLVGTPRRIRQAAVNRAEQYMLDRIEGDGTL

YTYASCTVLMVFALLALGYEPQHPVIQRAVEGLSQMKFTVDSTGQGGTRYVTIQNSPSTVWDT

ALISYALQEAGVSSSHPAIQRAADYLRNRQHRRPGDWQIHNPGIVPGGWGFSETNTFVPDVDD

TTAALRALSALHGSEPAVLGAWNRGLNWVWSMQNNDGGWPAFEKNTNKEMLTWLAIEGAKS

AATDPSEADLTGRTLEYLGNFAKLSVRQDWVARGADWLLSHQEADGSWYGRWGICYIYGTW

AALTGLMAVGMPADHPGIAKAANWLIRIQNADGGWGESCRSDQVRRYVPLHASTPSQTAWAL

DALIAVHDRRAPEIERGVARLIALLHEDDWPSTYPTGAGLPGYFYVHYHSYRYIWPLLALSHYV

NKYGDSSP

>seq_ID 45
MSGVLLYDKVREEIERRTTALQTMQRQDGTWSFCFEGALLTDCHMIFLLKLLGRNDEIEPFVKR

LASLQTNEGTWKLYEDENGGNLSATIQAYAALLASEKYSKEDINMRRAEMFIKEHGGVSRAHF

MTKFLLAIHGEYEFPTLFHFPTPILFLQDDSPLSIFELSSSARIHLIPMMICMNKRFRVEKKLLPNL

NHIAGEGGQWFREERSPLFQSFVGDVKKVIAYPLSLHHKGYEEVERFIGERIDENGTLYSYASA

TFYMIYALLALGHSIQSPIIEKAVIGLKSYIWKMDRGSHLQNSPSTVWDTALLSYSLQEANVMKE

NKMIQKATEYLLQRQQTKRMDWSVHAPSIMAGGWGFSDVNTTIPDVDDTTAALRALARSRGS

SRVDSAWERGVEWLKGLQNNDGGWGAFERGVTSRILANLPIENASDMITDPSTPDITGRVLEF

FGTYAPNELPEEQKKKAVKWLMDVQELNGSWYGKWGICYIYGTWAAMTGLRALGVPSSHPSL

KKAASWLEHLQYEDGGWGESCQSSVEKKFISLPFSTPSQTAWALDALISYYDQETPIIRKGISYL

LAQPTMNEKYPTGTGLPGGFYIRYHSYGHIYPLLALAHYIKKYKK

>seq_ID 53
MSGVLLYDKVHEEIERRTTALQTMQRQDGTWQFCFEGALLTDCHMIFLLKLLGRNDEIEPFVKR

LVSLQTNEGTWKLYEDEKGGNLSATIQAYAALLASERYSKEAMNMRRAEMFIKEHGGVSRAHF

MTKFLLAIHGEYEFPALFHFPTPILFLQDDSPLSIFGLSSSARIHLIPMMICMNKRFRVEKKLLPNL

NHIAGGGGQWFREERSPLFQSFLGDVKKVISYPLSLHHKGYEEVERFMKERIDENGTLYSYAS

ATFYMIYALLALGHSIQSPIIEKAVTGLKSYIWKMDRGSHLQNSPSTVWDTALLSYSLQEAKVTN

Enzyme Sequences

ENKMIQRATEYLLQKQQTKKVDWSVHASSLVAGGWGFSDVNTTIPDIDDTTAALRALARSRGN

DRVDDAWGRGVEWVKGLQNNDGGWGAFERGVTSKLLSNLPIENASDMITDPSTPDITGRVLE

LFGTYAPNELLEEQKKAIKWLMDVQEQNGSWYGKWGICYIYGTWATMTGLRALGVPSTHPA

LKKAASWLEHLQHEDGGWGESCQSSVEKKFISLPFSTPSQTAWALDALISYYDQETPIIRKGIS

YLLAQSTMNEKYPTGTGLPGGFYIRYHSYGHIYPLLALAHYVKKYRK

>seq_ID 44
MSGVLLYDKVHEEIERRTTALQTMQRQDGTWQFCFEGALLTDCHMIFLLKLLGRNDEIEPFVKR

LASLQTNEGTWKLYEDEKGGNLSATIQAYAALLASEKYSKEDMNMRRAEMFIKEHGGVSRAHF

MTKFLLAIHGEYEFPALFHFPTPILFLQDDSPLSIFGLSSSARIHLIPMMICMNKRFRVEKKLLPNL

NHIAGGGGQWFREERSPLFQSLLGDVKKVISYPLSLHHKGYEEVERFMKERIDENGTLYSYAS

ATFYMIYALLALGHSIQSPIIEKAVTGLKSYIWKMDRGSHLQNSPSTVWDTALLSYSLQEAKVTN

ENKMIQRATEYLLQKQQTKKVDWSVHASSLVAGGWGFSDVNTTIPDIDDTTAALRALARSRGN

DRVDDAWGRGVEWVKGLQNNDGGWGAFERGVTSKLLSNLPIENASDMITDPSTPDITGRVLE

LFGTYAPNELLEEQKKAIKWLMDVQEQNGSWYGKWGICYIYGTWATMTGLRALGVPSTHPS

LKKAASWLEHLQHEDGGWGESCQSSVEKKFISLPFSTPSQTAWALDALISYYDQETPIIRKGITY

LLAQSTMNEKYPTGTGLPGGFYIRYHSYGHIYPLLALAHYVKKYRK

>seq_ID 64
MSNLLLYEKVHEEIARRTTALQTMQRQDGTWRFCFEGAPLTDCHMIFLLKLLGRDKEIEPFVKR

LASLQTNEGTWKLYEDEAGGNLSATIQSYAALLASEKYTKEDANMKRAEMFINERGGVARAHF

MTKFLLAIHGEYEYPSLFHLPTPIMFLQNDSPLSIFELSSSARIHLIPMMLCLNKRFRVGKKLLPNL

NHIAGGGGEWFREDRSPVFQTLLSDVKKIITYPLSLHHKGYEEVERFMKERIDENGTLYSYATA

SFYMIYALLALGHSIQSPIIEKAITGITSYIWKMERGSHLQNSPSTIWDTALLSYALQEAQVPKASK

VIHNASAYLLRKQQTKKVDWSVHAPDLFPGGWGFSDVNTTIPDIDDTTAALRALARSRGNENV

DNAWKRAVNWVKGLQNNDGGWGAFEKGVTSRILANLPIENASDMITDPSTPDITGRVLEFFGT

YTQNELPEKQKQSAINWLMNVQEENGSWYGKWGICYIYGTWAVMTGLRSFGIPSSNPSLKRA

ALWLEHIQHEDGGWGESCQSSVEKRFVTLPFSTPSQTAWALDALISYYDKETPVIRKGISYLLS

NSYINEKYPTGTGLPGGFYIRYHSYAHIYPLLTLAHYAKKYKK

>seq_ID 68
MLLYEKVHEEIARRTTALQTMQRQDGTWRFCFEGAPLTDCHMIFLLKLLGKDKEIEPFVKRLAS

LQTNEGTWKLYEDEVGGNLSATIQSYAALLASEKYTKEDVNMKRAEMFINEHGGVARAHFMTK

FLLAIHGEYEYPSLFHLPTPIMFLQNDSPLSIFELSSSARIHLIPMMLCLNKRFRVGKKLLPNLNHI

AGGGGEWFREDRSPVFQTLVSDVKKIITYPLSLHHKGYEEVERFMKERIDENGTLYSYATASFY

MIYALLALGHSIQSPIIQKAITGITSYIWKMERGSHLQNSPSTVWDTALLSYALQEAQVPKASKVI

HNASAYLLRKQQTKKVDWSVHAPDLFPGGWGFSDVNTTIPDIDDTTAALRALARSRGNENVDT

AWKRAVNWVKGLQNNDGGWGAFEKGVTSRILANLPIENASDMITDPSTPDITGRVLEFFGTYT

QNELPEKQKQSAINWLMNVQEENGSWYGKWGICYIYGTWAVLTGLRSLGIPSSDPSVKRAAL

WLEHIQHEDGGWGESCQSSVEKRFVTLPFSTPSQTAWALDALISYYDKETPVIRKGISYLLSNS

YINEKYPTGTGLPGGFYIRYHSYAHIYPLLTLAHYAKKYRK

>seq_ID 41
MSNLLLYEKVHEEIARRTTALQTMQRQDGTWQFCFEGAPLTDCHMIFLLKLLGRDKEIEPFVKR

LASLQTNEGTWKLYEDEMGGNLSATIQSYAALLASEKYTKEDANMKRAEMFINERGGVARAHF

| Enzyme Sequences |
| --- |
| MTKFLLAIHGEYEYPSLFHLPTPIMFLQNDSPLSIFELSSSARIHLIPMMLCLNKRFRVGKKLLPNL
NHIAGGGGEWFREDRSPVFQTLVSDVKKIITYPLSLHHKGYEEVERFMKERIDENGTLYSYATA
SFYMIYALLALGHSIQSPIIQKAITGITSYIWKMERGSHLQNSPSTVWDTALLSYVLQEAQVPKAS
KVIHNASAYLLRKQQTKKVDWSVHAPDLFPGGWGFSDVNTTIPDIDDTTAALRALARSRGNEN
VDTAWKRAVNWVKGLQNNDGGWGTFEKGVTSRILANLPIENASDMITDPSTPDITGRVLEFFG
TYTQNELPEKQKQSAINWLMNVQEENGSWYGKWGICYIYGTWAVLTGLRSLGIPSSDPSVKRA
ALWLEHIQHEDGGWGESCQSSVEKRFVTLPFSTPSQTAWALDALISYYDKETPVIRKGISYLLS
NSYINEKYPTGTGLPGGFYIRYHSYAHIYPLLTLAHYAKKYRK >seq_ID 66
MSNLLLYEKVHEEIARRTTALQTMQRQDGTWQFCFEGAPLTDCHMIFLLKLLGRDKEIEPFVKR
LASLQTNEGTWKLYEDEMGGNLSATIQSYAALLASEKYTKEDANMKRAENFIKERGGVARAHF
MTKFLLAIHGEYEYPSLFHLPTPIMFLQNDSPLSIFELSSSARIHLIPMMLCLNKRFRVGKKLLPNL
NHIAGGGGEWFREDRSPVFQTLASDVKKIITYPLSLHHKGYEEVERFMKERIDENGTLYSYATA
SFYMIYALLALGHSIQSPIIEKAIMGITSYIWKMERGSHLQNSPSTIWDTALLSYALQEAQVPKAS
KVIQNASAYLLRKQQTKKVDWSVHAPDLFPGGWGFSDVNTTIPDIDDTTAVLRALARSRGNEN
VDNAWKRAVNWVKGLQNNDGGWGAFEKGVTSRILANLPIENASDMITDPSTPDITGRVLEFFG
TYGQNELPEKQKQSAINWLTNAQEENGSWYGKWGICYIYGTWAVLTGLRSLGIPSSDPSLKRA
ALWLEHIQHEDGGWGESCHSSVEKRFVTLPFSTPSQTAWALDALISYYDKETPVIRKGISYLLS
NPYINEKYPTGTGLPGGFYICYHSYAHIYPLLTLAHYAKKYRK >seq_ID 138
MVADERSALIDALKRSQSVDGSWRFPFETGISTDAYMIILLRTLGIHDEPLIQALVERIESRQDAN
GAWKLFADEGDGNVTATVEAYYALLYSGYRKKTDSHMQKAKARILEVGGLERVHLFTKVMLAL
TGQHSWPRRFPLPLVFFLLPPSFPLNMYDLSVYGRANMVPLLVVAERRYSRKTDNSPDLSDLA
ASRNDWRLPDTEALWSYVKRSLTGLPAWLHRAAEQRAVRYMLEHIEPDGTLYSYFSSTFLLIFA
LLALGYPKDDPHIARAVRGLRSLRTEIDGHTHMQYTTASVWNTALASYALQEAGVPPTDRTIEK
ANRYLLSRQHIRYGDWAVHNPYGVPGGWGFSDVNTMNPDVDDTTAALRAIRRAAAKETAFRH
AWDRANRWLFSMQNDDGGFAAFEKNVGKRFWRYLPIEGAEFLLMDPSTADLTGRTLEYFGTF
AGLTKDHSAIARAIDWLLDHQEADGSWYGRWGICYVYGTWAAVTGLSAVGVPIDHPAMQKAV
RWLLSIQNDDGGWGESCKSDGAKTYVPLGASTPVHTAWALDALIAAAERPTPEMKAGVRALV
RMLHHPDWTASYPVGQGMAGAFYIHYHGYRYIFPLLALAHYEQKFGPFVD >seq_ID 69
MLLYEKVHEEIARRTTALQTMQRQDGTWRFCFEGAPLTDCHMIFLLKLLGRDKEIEPFVKRLAS
LQTNEGTNKLYEDEVGGNLSATIQSYAALLASEKYTKEDANMKRAEMFINERGGVARAHFMTK
FLLAVHGEYEYPSLFHLPTPIMFLQNDSPLSIFELSSSARIHLIPMMLCLNKRFRVGKKLLPNLNHI
AGGGGEWFREDRSPVFQTLLSEVKKIITYPLSLHHKGYEAVERFMKERIDENGTLYSYATASFY
MIYALLALGHSIQSPIIQKAITGITSYIWKMERGSHLQNSPSTVWDTALLSYALQEAQVPKASKGI
QNASAYLLRKQQTKKVDWSVHAPDLFPGGWGFSDVNTTIPDIDDTTAVLRALARSRGNENVD
NSWKRAVNWVKGLQNNDGGWGAFEKGVTSRILANLPIENASDMIPDPSTPDITGRVLEFFGTY
AQNELPEKQKQSAINWLMNIQEENGSWYGKWGICYIYGTWAVLTGLRSLGIPSSDPSLKRAAL |

Enzyme Sequences

WLEHIQHEDGGWGESCQSSVEKRFVTLPFSTPSQTAWALDALISYYEKETPVIRKGISYLLSNP

YVNEKYPTGTGLPGGFYIRYHSYTHIYPLLTLAHYAKKYRK

>seq_ID 67
MSNLLLYEKVHEEIARRTTALQTMQRDGTWRFCFEGAPLTDCHMIFLLKLLGRDKEIEPFVKR

LASLQTNEGTWKLYEDEVGGNLSATIQSYAALLASEKYTKEDANMKRAEMFINERGGVARAHF

MTKFLLAIHGEYEYPSLFHLPTPIMFLQNDSPLSIFELSSSARIHLIPMMLCLNKRFRVGKKLLPNL

NHIAGGGGEWFREDRSPVFQTLLSEVKKIITYPLSLHHKGYEEVERFMKERIDENGTLYSYATA

SFYMIYALLALGHSIQSPIIQKAITGIASYIWKMERGSHLQNSPSTVWDTALLSYALQEAQVPKAS

KVIQNASAYLLRKQQTKKVDWSVHAPNLFPGGWGFSDVNTMIPDIDDTTAVLRALARSRGDEN

VDNAWKRAVNWVKGLQNNDGGWGAFEKGVTSRILANLPIENASDMITDPSTPDITGRVLEFFG

TYAQNELPEKQKQSAINWLMNVQEENGSWYGKWGICYNGTWAVLTGLRSLGIPSSDPSLKRA

ALWLEHIQHEDGGWGESCQSSVEKRFVTLPFSTPSQTAWALDALISYYEKETPIIRKGISYLLSN

PYVNEKYPTGTGLPGGFYIRYHSYAHIYPLLTLAHYTKKYRK

>seq_ID 35
MSNLLLYEKAHEEIVRRATALQTMQWQDGTWRFCFEGAPLTDCHMIFLLKLLGRDKEIEPFVER

VASLQTNEGTWKLYEDEVGGNLSATIQSYAALLASKKYTKEDANMKRAENFIQERGGVARAHF

MTKFLLAIHGEYEYPSLFHLPTPIMFLQDDAPFSIFELSSSARIHLIPMMLCLNKRFRVGKKLLPN

LNHIAGGGGEWFREDRSPVFQTLLSDVKQIISYPLSLHHKGYEEIERFMKERIDENGTLYSYATA

SFYMIYALLALGHSLQSSMIQKAIAGITSYIWKMERGNHLQNSPSTVWDTALLSYALQEAQVSK

DNKMIQNATAYLLKKQHTKKADWSVHAPALTPGGWGFSDVNTTIPDIDDTTAVLRALARSRGN

KNIDNAWKKGGNWIKGLQNNDGGWGAFEKGVTSKLLAKLPIENASDMITDPSTPDITGRVLEFF

GTYAQNELPEKQIQRAINWLMNVQEENGSWYGKWGICYIYGTWAVMTGLRSLGIPSSNPSLKR

AASWLEHIQHEDGGWGESCHSSVEKRFVTLPFSTPSQTAWALDALISYYDTETPAIRKGVSYLL

LNPYVNERYPTGTGLPGAFYIRYHSYAHIYPLLTLAHYLKKYRK

>seq_ID 43
MNALLLYEKVHEEIARRTTALQTMQRDGTWRFCFEGAPLTDCHMIFLLKLLGRDKEVEPFVK

RLASLQTNEGTWKLYDDEMGGNLSATIQSYAALLASKKYTKEDANMKRAEMFITERGGVARAH

FMTKFLLAIHGEYEYPSLFHLPTPIMFLQNDSPLSIFELSSSARIHLIPMMLCLNKRFRVGKKLLP

NLNHIAGGGGEWFREDQSPMFQTLLGNVKQIISYPLSLHHKGNEEVERFMKERIDENGTLYSY

ASASFYMIYALLALGHSIQSPMIQKAITGITSYIWKMERGNHLQNSPSTVWDTALLSYALQEARV

SKESKMIQNASAYLLKKQHKKADWSVHAPVLIPGGWGFSDVNTTVPDVDDTTAVLRALAQSR

GNGNVDDAWKKGTNWIKGLQNNDGGWGAFEKGVTSKLLANLPIENASDMITDPSTPDITGRVL

EFFGTYTQNELPEKQKQSAINWLMNEQEENGSWYGKWGICYIYGTWAVMTGLRALGITSAHP

SLKRATLWLEHIQHEDGGWGESCQSSVEKRFATLPFSTPSQTAWALDALISYYDKETPAIRKGI

SYLLANPYVNEKYPTGTALPGGFYIHYHSYAHIYPLLTLAHYAKKYKK

>seq_ID 33
MNIVIRISKGWVSNLLLYEKVHEEIARRTTALQTMQRDGTWQFCFEGAPLTDCHMIFLLKLLG

RDKEIEPFVKRLASLQTNEGTWKLYEDEVGGNLSATIQSYAALLASKKYTKEDANMKRAEMFIN

ERGGVARAHFMTKFLLAIHGEYEYPSLFHLPTPIMFLQNDSPLSIFELSSSARIHLIPMMVCLNKR

FQVGKKLLPNLNHIAGGGGEWFREDRSPMFQTLLSDVKQIISYPLSLHHKGYEEVERFMKERID

ENGTLYSYATASFYMIYALLALGHSLQSSMIQKAIAGITSYIWKMEKGNHLQNSPSTVWDTALLS

Enzyme Sequences

YTLQEAHASKDNKMIQHAAAYVLKKQHTKKADWSVHAPGLIPGGWGFSDVNTTIPDVDDTTAV

LRALARSRGNENVDNAWKKGVNWVKGLQNNDGGWGAFEKGVTSNLLANLPIENASDMITDPS

TPDITGRVLELFGTYAQNELPEKQKQSAINWLMNVQEENGSWYGKWGICYIYGTWAVMTGLR

SLGIPSSNPSMKRAALWLEHIQHEDGGWGESCQSSVEKRFITLPFSTPSQTAWALDALISYHDE

ETPAIRKGISYLLANPYVNEKYPTGTGLPGGFYIHYHSYAYIYPLLTLAHYIKKYRK

>seq_ID 36
MSNLLLYEKVHEEIARRATALQTMQRQDGTWRFCFEGAPLTDCHMIFLLKLLGRDKEIEPFVKR

LASLQTNEGTWKLYEDEVGGNLSATIQSYAALLASQKYTKEDANMKRAENFIKERGGVARAHF

MTKFLLAIHGEYEYPSLFHVPTPIMFLQNDSPLSIFELSSSARIHLIPMMVCLNKRFRVGKKLLPN

LNHIAGGGGEWFREDRSPLFQTLLSDVKQIISYPLSLHHKGYEEVERFMKERIDENGTLYSYAT

ASFYMIYALLALGHSLQSSMIQKAIAGITSYIWKMERGSHLQNSPSTVWDTALLSYALQEAQVPK

DHKMIQQTITYLLKKQHTKKADWSVHAPALTPGGWGFSDVNTTVPDVDDTTAVLRVLARSREN

EKVNNAWQKGIDWVKGLQNNDGGWGAFEKGVTSKLLANLPIENASDMITDPSTPDITGRVLEL

FGTYTQNELPEKQKQSAINWLMNAQEENGSWYGKWGICYIYGTWAVMTGLRSLGIPSNNPSL

KRAALWLEHIQHEDGGWGESCQSSMEKRFITLPFSTPSQTAWALDALISYYDTETPAIRKGISY

LLANPYVNEKYPTGTGLPGGFYIRYHSYAQIYPLLTLAHYTKKYRK

>seq_ID 42
MSNLLLYEKVHEEIARRTTALQTMQRQDGTWRFCFEGAPLTDCHMIFLLKLLGRDKEIEPFVKR

LASLQTNEGTWKLYEDEVGGNLSATIQSYAALLASEKYTKEDANMKRAEMFINERGGVARAHF

MTKFLLAIHGEYEYPSLFHLPTPIMFLQNDSPLSIFELSSSARIHLIPMMLCLNKRFRVGKKLLPNL

NHIAGGGGEWFREDRSPVFQTLVSDVKKIITYPLSLHHKGYEEVERFMKERIDENGTLYSYATA

SFYMIYALLALGHSIQSPIIEKAIMGITSYIWKVERGSHLQNSPSTIWDTALLSYALQEAQVPKASK

VIQNASAYLLRKQQTKKVDWSVHAPDLFPGGWGFSDVNTTIPDIDDTTAVLRALARSRGNEHV

DNAWKRAVNWVKGLQNNDGGWGAFEKGVTSRILANLPIENASDMITDPSTPDITGRVLEFFGT

YTQNELPEKQKQSAINWLMNVQEENGSWYGKWGICYIYGTWAVLTGLRSLGIPSSDSSLKRAV

LWLEHIQHEDGGWGESCQSSVEKRFVTLPFSTPSQTAWALDALISYYDKETPVIRKGISYLLSN

PYINEKYPTGTGLPGGFYIRYHSYAHIYPLLTLAHYAKKYRK

>seq_ID 65
MSNLLLYEKVYEEIARRTTALQTMQRQDGTWRFCFEGAPLTDCHMIFLLKLLGRDKEIEPFVKR

LASLQTNEGTWKLYEDEVGGNLSATIQSYAALLASEKYTKEDANMKRAEMFINERGGVARAHF

MTKFLLAIHGEYEYPSLFHLPTPIMFLQNDSPLSIFELSSSARIHLIPMMLCLNKRFRVGKKLPNL

NHIAGGGGEWFREDRSPVFQTLVSDVKKIITYPLSLHHKGYEEVERFMKGRIDENGTLYSYATA

SFYMIYALLALGHSIQSPIIEKAIMGITSYIWKMERGSHLQNSPSTIWDTALLSYALQEAQVPKVS

KVIQNASAYLLRKQQTKKVDWSVHAPDLFPGGWGFSDVNTTIPDIDDTTAVLRALARSRGNEN

VDNAWKRAVNWVKGLQNNDGGWGAFEKGVTSRILANLPIENASDMITDPSTPDITGRVLEFFG

TYTQNELPEKQKQSAINWLMNVQEENGSWYGKWGICYIYGTWAVLTGLRSLGIPSSDSSLKRA

VLWLEHIQHEDGGWGESCQSSVEKRFVTLPFSTPSQTAWALDALISYYDKETPVIRKGISYLLS

NPYINEKYPTGTGLPGGFYIRYHSYAHIYPLLTLAHYAKKYRK

>seq_ID 39
MNNLLLYEKVHEEIARRATALQTMQQDGTWRFCFEGAPLTDCHMIFLLKLLGRDKEIEPFVKR

LASLQTNEGTWKLYEDEVGGNLSATIQSYAALLASKKYTKEDANMKRAENFIKERGGVARAHF

Enzyme Sequences

MTKFLLAIHGEYEYPSLFHLPTPIMFLQNDSHLSIFELSSSARIHLIPMMLCLNKRFRVGKKLLPSL
NHIAGGGGEWFREDRSPLFQTLVSDVKQIISYPLSLHHKGYEEVERFMKERIDENGTLYSYATA
SFYMIYALLALGHSLQSTMIQKAITGITSYIWKMESGNHLQNSPSTVWDTALLSYALQEAHVPKD
NKMIQHAATYLLKKQHTQKADWSVHAPALTPGGWGFSDVNTTIPDVDDTTAVLRALARSRGNE
KVDNAWPKGINWVKGLQNNDGGWGAFEKGVTSNILANLPIENASDMITDPSTPDITGRVLEFF
GKYAQNELPEKQKQSAINWLMNVQEENGSWYGKWGICYIYGTWAVMTGLRSLGIPSSNPSMK
RAALWLEHIQHEDGGWGESCHSSVEKRFVTLPFSTPSQTAWALDALISYYDKETSIIRKGISYLL
ANPYVNEKYPTGTGLPGGFYIRYHSYAHIYPLLTLAHYIKKYRK

>seq_ID 63
MSNLLLYEKAHEEIARRATALQTMQREDGTWRFCFEGAPLTDCHMIFLLKLLGRDKEIEPFVKR
LATLQTNEGTWKLYEDEVGGNLSATIQSYAALLASGKYTKEDANMKRAENFIKERGGVARAHF
MTKFLLAIHGEYEYPSLFHVPTPIMFLQNDSPLSIFELSSSARIHLIPMMLCLNKRFRVGKKLLPN
LNHIAGGGGEWFREERSPLFQTLLSDVKQIISYPLSLHHKGYEEVERFMKERIDENGTLYSYAT
ASFYMIYALLALGHSLQSSMIQKAIAGITSYIWKMESGNHVQNSPSTVWDTALLSYALQEAHVP
KDNKMLQNATAYLLKKQHTKKADWSVHAPALTPGGWGFSDVNTTVPDVDDTTAVLRVLARSK
GNEKLDHAWQKGINWVKGLQNNDGGWGAFEKGVTSRILANLPIENASDMITDPSTPDITGRVL
EFFGTYAQNELPEKQKQSAINWLMNAQEENGSWYGKWGICYIYGTWAVMTGLRSFGIPSSNP
SLKRAALWLEHIQHKDGGWGESCHSSVEKRFVTLPFSTPSQTAWALDALISYYDTETPVIRKGI
SYLLANPYVNEKYPTGTGLPGGFYIRYHSYAHIYPLLTLTHYIKNIENKPRDISRFIFLGSRSLLKRI
RLCFPYFSVDWRF >seq_ID 37
MSNLLLYEKAHEEIARRATALQTMQREDGTWRFCFEGAPLTDCHMIFLLKLLGRDKEIEPFVKR
LASLQTNEGTWKLYEDEVGGNLSATIQSYAALLASGKYTKEDANMKRAENFIKERGGVARAHF
MTKFLLAIHGEYEYPSLFHVPTPIMFLQNDSPLSIFELSSSARIHLIPMMLCLNKRFRVGKKLLPN
LNHIAGGGGEWFREERSPLFQTLLSDVKQIISYPLSLHHKGYEEVERFMKERIDENGTLYSYAT
ASFYMIYALLALGHSLQSSMIQKAIAGITSYIWKMESGNHVQNSPSTVWDTALLSYALQEAHVP
KDNKMLQNATAYLLKKQHTKKADWSVHAPALTPGGWGFSDVNTTVPDVDDTTAVLRVLARSK
GNEKLDHAWQKGINWVKGLQNNDGGWGAFEKGVTSRILANLPIENASDMITDPSTPDITGRVL
EFFGTYAQNELPEKQKQSAINWLMNAQEENGSWYGKWGICYIYGTWAVMTGLRSFGIPSSNP
SLKRAALWLEHIQHKDGGWGESCHSSVEKRFVTLPFSTPSQTAWALDALISYYDTETPVIRKGI
SYLLANPYVNEKYPTGTGLPGGFYIRYHSYAHIYPLLTLTHYIKKYRK >seq_ID 46
MLLYEKVHEEVKEKMAALQAMQQQDGTWRFCFEGSPLTDCYMIFLLTLLGQDQEIEPFVARLA
ALQTNEGTWKLYEDEPDGNLSATIQAYAALLVSKMYKKEDINMKRAEVFIRKQGGITKAHFMTK
FLLALHGGYEYPPLFHFPTPILFLSEDSPLSIFELSSSARIHLIPMMLCMNKRFTVSKKMLPNLDYI
SGGSKEQWFREERSPLFQTLLRDVTKFLSYPLSLHYKGDKAAERFMIERIDTNGTLYSYASATF
YMIYALLALGHSIQSPLISNAVLGLKTYVWNMDRWAHLQNSPSTVWDTALLSYSLQEARVPHD
NEMIQKAINYLLQKQHKEKKDWSVHAPTLDAGGWGFSDVNTTIPDVDDTTAVLRALAGSRQGN
PKVESAWRKGIEWVKGLQNSDGGWAAFEKGVTSKVLTHLPLDNSGDMITDPSTVDITGRVLEF
FGTYAPNELQGDQKDRAIRWLIYTQEKNGSWHGKWGVCYIYGTWAALTGLRAVGVPSNHIAL

Enzyme Sequences

QKAATWLESIQHSDGGWGESCRSSVEKKFISLPFSTPSQTAWALDALIACYDSETPTIRKGISYL

LKHSTKHQEYPTGTALANGFYIRYHSYHHIFPLLTFAHYIKKYRK

>seq_ID 40
MSNLLLYEKVHEEIARRTTALQTMQRRDGTWRFCFEGAPLTDCHMIFLLKLLGRDKEIEPFVKR

LASLQTNEGTWKLYEDEVGGNLSATIQSYAALLASKKYTKEDANMKRAEMFINERGGVARAHF

MTKFLLAVHGEYEYPSLFHLPTPIMFLQSDSPLSIFELSSSARIHLIPMMLCLNKKFRIRKKLLPNL

NHISGGGGEWFRGNRSPLFQTLVSDVKQIISYPLSLHHKGNEEVERFMKERIDENGTLYSYATA

SFYMIYALLALGHSLQSTMIQKAITGITSYIWNMESGNHLQNSPSTVWDTALLSYALQEAHVPKD

TNMLQHATAYLLKKQHTKKADWSVHAPALAPGGWGFSDVNTTIPDVDDTTAVLRALARSRGS

EKVDYVWEKGINWVKGLQNNDGGWGAFEKGVTSNLLANLPIENASDMITDPSTPDITGRVLEL

FGTYAQNELPEKQTQSAINWLMNVQEKNGSWYGKWGICYIYGTWAVMTGLRSLGIPSSNPSL

KRAALWLEHIQHEDGGWGESCHSSVEKRFVTLPFSTPSQTAWALDALISYYDKETPAIRKGISY

LLANRYVNEKYPTGTGLPGGFYICYHSYAHIYFPLLTLAHYIKKYRK

>seq_ID 38
MSNLLLYEKAHEEIARRATALQSMQWQDGTWRFCFEGAPLTDCHMIFLLKLLGRDKEIEPFVK

RLASLQTNEGTWKLYEDEVGGNLSATIQSYAALLASGKYTKEDANMKRAENFIKERGGVARAH

FMTKFLLAVHGEYEYPSLFHLPTPIMFLQNDSPLSIFELSSSARIHLIPMMLCLNKRFRVGKKLLP

NLNHIAGGGGEWFREERSPLFQTLVSDVKQIISYPLSLHHKGYEEVERFMKERIDENGTLYSYA

TASFYMIYALLALGHSLQSSIIQNAITGITSYIWKMESGNHLQNSPSTVWDTALLSYALQEAHVPK

DNKMLQNATAYLLKKQHTKKADWSVHASALTPGGWGFSDVNTTVPDVDDTTAVLRVLARSRG

NEKVDHAWQKGINWVKGLQNNDGGWGAFEKGVTSNILAKLPIENASDMITDPSTPDITGRVLE

FFGTYAQNELPEKQKQSAINWLMNVQEENGSWYGKWGICYIYGTWAVMTGLRSFGIPSSNPS

LKRAALWLEHIQHKDGGWGESCHSSVEKRFVTLPFSTPSQTAWALDALISYYDTETPIIRKGISY

LLANPYVNEKYPTGTGLPGGFYIRYHSYAHIYPLLTLAHYIKKYRK

>seq_ID 55
MLLYEKVRQEVERKVTALRTMQYQDGAWRFCFEGSPLTDCHMIFLLRLLGQNGEMEPFVTRV

ASLQTNEGTWKLYEDESVGNLSTTINAYVALLASGRYTKEDINMKRAEAFIRRQGGITKAHFMT

KFLLALHGGYEYPSLFHFPTPMLFLPEDSPLSIFELSSSARIHLIPMMICMNKRFTVSKTILPNLDY

ISGGSKKQWFREERSSLFQRLLGDVKKFLSYPLSLQHKGYKEAERFMIERIETNGTLYSYASAT

FYMIYALLALGHSIQSPLISNAVLGLKSYIWNMNKGTHLQNSPSTVWDTALLSYSLQEAGVPND

NQMIQKATDYLLQKQHKEKKDWSVHAPSLDAGGWGFSDVNTTIPDIDDTTAALRAIARSREGN

QRIEEAWRKGIEWVKGLQNIDGGWAAFERGVTSHFLTHLPLDNAGDMTTDPSTSDITGRVLEF

FGTYAPHQLKDDQKDRAIKWLMQAQEKNGSWYGKWGVCYIYGTWAALTGLRAVGVPSNHTA

LQKAATWLERIQHNDGGWGESCRSSIEKHFISLPFSTPSQTAWALDALITFYDTETPVIRKGISY

LLAHLNQNQDYPTGIGLPDGFYIRYHSYHHIFPILTFAHYIKKYMK

>seq_ID 54
MLLYEKVRQEVERKVTALRTTQYQDGAWRFCFEGSPLTDCHMIFLLRLLGQNGEMEPFVTRV

ASLQTNEGTWKLYEDESVGNLSTTINAYVALLASGRYTKEDINMKRAEAFIRRQGGITKAHFMT

KFLLALHGGYEYPSLFHFPTPMLFLPEDSPLSIFELSSSARIHLIPMMICMNKRFTVSKTIFPNLDY

ISGGSKKQWFREERSPLFQTLLGDVKKFLSYPLSLQHKGYKEAERFMIERIETNGTLYSYASAT

FYMIYALLALGHSIQSPLISNAVLGLKSYIWNMNKGTHLQNSPSTVWDTALLSYSLQEAGVPND

Enzyme Sequences

NQMIQKATDYLLQKQHKEKKDWSVHAPSLDAGGWGFSDVNTTIPDIDDTTAALRAIARSREGN

QRIEEDWRKGIEWVKGLQNIDGGWAAFERGVTSHFLTHLPLDNAGDMTTDPSTSDITGRVLEF

FGTYAPHQLKDDQKDRAIKWLMQAQEKNGSWYGKWGVCYIYGTWAVLTGLRAVGVPSNHTA

LQKAATWLERIQHNDGGWGESCRSSIEKHFISLPFSTPSQTAWALDALITFYDTETPVIRKGISY

LLAHLNQNQDYPTGIGLPDGFYIRYHSYHHIFPILTFAHYIKKYMK

>seq_ID 189
MRSELLQLQSADGSWRLCFDSGTMPDSYFIIILRMLGYSQDEALIRQIASRILSRQLPNGTWKIY

PDEEDGNLDATAEAYFALLYSGFLTKLDPRMQLAKQFILSKGGLSKIRSLLTQAIFAAAGQASWP

KSMRIPLEVFFSDNGIGIDLFSLSGHARVHIVPIIMLANAQFVQHSASMPDLSDLFAGSSKRFEN

DSPWIAALATLIGSLSLSELLPFESPTPQEKAVQFLFDRLEPDGTLLTYTTATMFMILVLLMLGYS

SSSPLIHRMVSGIHSVICANSHVQIASSEVWDTAMLVHALRKAGVNPTSTALENAGAYLRQRQQ

TQLGDWAIRNPGTPAGGWGFSNVNTLYPDVDDTTAALRAIQPYSSRTPELQADWQRGLNWVL

TMRNDNGGWPAFERQGSRLPITFFNFEGAKDIAVDPSTVDLTSRTLQFLGQELGMNAGNSWIE

STLRWVLSQQESNGSWYGRWGITYVHGTSAALQGLTAVGIAEDHPAVKKGVDWLLQVQNED

GGWGESCISDKVRRYVPLNFSTPSQTAWALDGLTAALPKPTPALERGVDALLQSLDRHDWTY

TYPTGGALPGSVYAHYASNNYIWPLLALSNIWQKYS

>seq_ID 200
MALPFNQDSYKGDDEADVSKGAAKSPPSLEEAIQRSQEFLLAQQFPEGFWFGELEANVTIISHT

VILYKLLGIEENFPMYKFERYLRRMQCSHGGWEIAYGIGSYLSATIEAYIALRLLNVPQSDPALQK

ALRVILDSGGVTKARIFTKICLALLGSFDWRGIPSLPPWLILCPTWFPLSIYEVSSWARGCIVPLL

VILDKKPVFKVSPEVSFDELYAEGREHACKIIPISGDWTSKFFITVDRVFKMMERLRVVPFRQW

GIREAEKWILERQEESGDYVNIFPAMFYSVMCMKVLGYETTDPVVQRALLGFKGFTIETADECK

VQSTVSPIWDTAFIVRALVDSGIPPDHPALQKAGQWLLQKQILKHGDWAFKDRQNPVNQRGFA

CLQRDSQIETADECRVQSTLSPVWDTAFVVKALVDSGIPPNHPALQKAGQWLLQNQTLTHGD

WAFKTQSGHLAAGGWAFQSHNRWYPDADDSAAVMMALDCIELPDEDVKNGAIARGLKWISAL

QSRNGGWAGYDKNCDQQWINKVPFNDLNGILDVPTADVTARVLEMVGRLSRLGAVGTPYSPR

HCTLVESIPHLLLPETIARGLAYLRREQEGEGCWWGKWGVNYIYGTCGALLALSQVAPTTHQE

EIARGAKWLAQVQNRCDKQKAAQGPRDGGWGESCFSYDDPALKGQNDASTASQTAWAVQG

LLAAGDALGKYEVEAIEQGVQYLLATQRKDGTWHEAHFTGSCFAQHFYVRYHYYAQHFPLSAL

GLYRTRILQHQ

>seq_ID 139
MVADERSALIDALKRSQSVDGSWRFPFETGISTDAYMIILLRTLGIHDEPLIQALVERIESRQDAN

GAWKLFADEGDGNVTATVEAYYALLYSGYRKKTDSHMQKAKARILEVGGLERVHLFTKVMLAL

TGQHSWPRRFPLPLVFFLLPPSFPLNMYDLSVYGRANMVPLLVVAERRYSRKTDNSPDLSDLA

ASRNDWRLPDTEALWSYVKRSLTGLPAWLHRAAEQRAVRYMLEHIEPDGTLYSYFSSTFLLIFA

LLALGYPKDDPHIARAVRGLRSLRTEIDGHTHMQYTTASVWNTALASYALQEAGVPPTDRTIEK

ANRYLLSRQHIRYGDWAVHNPYGVPGGWGFSDVNTMNPDVDDTTAALRAIRRAAAKETAFRH

AWDRANRWLFSMQNDDGGFAAFEKNVGKRFWRYLPIEGAEFLLMDPSTADLTGRTLEYFGTF

AGLTKDHSAIARAIDWLLDHQEADGSWYGRWGICYVYGTWAAVTGLSAVGVPIDHPAMQKAV

Enzyme Sequences

RWLLSIQNDDGGWGESCKSDGAKTYVPLGASTPVHTAWALDALIAAAERPTPEMKAGVRALV
RMLHHPDWTASYPVGQGMAGAFYIHYHGYRYIFPLLALAHYEQKFGPFVD

>seq_ID 13
MAQMASSLGSPRLLLRMGREAAQQQHLASGTEVQKALRLAVGHSLDLQRTDGAWCGEVHSN
ATFTAQYVFLQQQIGLPLDPTEIEGLSRWLFSQQNEDGSWGLGPGLGGDVSTTTETYLALKILG
VSPEDPRMAAARTSIIKAGSLPATRMFTRVFLASFGLIPWSAVPPLPAELILLPTLFPVNIYNLSS
WARATCVPLLLIRHHEPLHSLPNGRHAENDFLDELWTKDIPRDFCYTTPLSRMWRLGDYAGIFF
TSADHGFRFLGQYFNSPLRNLSRRKIINWILDHQEQSGEWAGYWPPQHNNIWALSLEGYSLDH
PVLRRGIAAVKSFVLHDATGMRAQVTVSQVWDTALMSIALSDSAPSTGIISPTQAIDWLMHHEV
ASHRGDWRVLRPKLATGGFCFEEFNTLYPDVDDTAAVIMALIKSNPAHLISGCVRQCFGMMMA
GRHGYSLDCQLETRLRASSQLAIAYLLGCQENNGSWWGRWGVNYLYGTSNVLCGLAYYYDR
SSLSKGDGKSNSNIVSAVDRASEWLKARQHSNGGWGEGLESYDNAQLAGCGQPTASQSAW
VTMALLNYLSPTDEVIQRGVSYLVRNQVKYGDESRATWPLERYTATGFPGHLYMEYDYYRHYF
PIMALGRYVNKLSGSHKLL >seq_ID 198
MEDLTQKLQQALQLASRALLNERVRPGLAHWEGELSTSALSTATAVMALFQYAKCQQASGRL
QKVFDGKSEGDWRLIEQGLAWLLQHQLADGGWGDTDKSISNISTTMLAHATLVACREAVRQK
SLVLNASDIDAAIERSGRLIEELGGIQAIRDRYGKDHTFSVPILTHAALAGLVSWNEIPALPYELAL
LPHRFFEVIQLPVVSYALPALIAIGQTLHLRQRTWNPWWWVRRAAIPGTLQKLQSIQPESGGFL
EATPLTSFVTMCLASVGRVDHPVTQAGLKFIRDSVRPDGSWPIDTNLATWVTTLSINHLGAEAF
SSDEREALMRWLLQQQYRTMHPYTNAAPGGWAWTNLSGGVPDADDTPGAMLALMELDRVS
VSSQESLSIEQALYQAALWLIKLQNRDGGWPTFCRGWGALPFDRSSNDITAHCLRALIQYERRL
NDVTVDATGDTTSRPLAVEVPSPKLREQMQRSIQQGFEYLEKTQREDGSWLPLWFGNQHSPD
DENPLYGTARVLLAYADAGLEGSSAALRGCDWLVRHQHADGAWGPGTSIETADTSDAESDVE
GEPASIEETALALMALCRFDATHNVLHRGASWLITKVENETWREPTPIGFYFAKLWYYEKLYPQ
VFTVGALKALALRLGSALTTVSENEPAPSSAEPPIPPIATDRVADSMHLQRTSPSINLANGGITLA >seq_ID 252
SPVWDTVLTLLALDDCGYNDCYSEEVDKAVQWVLDQQVLSKGDWSVKLPNVEPGGWAFEYA
NTRYPDTDDTAVALIVLSQFKDDPKWKERGINQAIERGVNWLFEMQCKNGGWGAFDKDNDKT
LLTKIPFCDFGEALDPPSVDVTAHIVEAFGKLGYSKDHPKIAHAIEYLKEEQEADGAWFGRWGV
NYVYGTGAVLPALEAIGEDMSQPYIRKAANWLVLHQNEDGGWGE >seq_ID 253
SPVWDTVLTLLAFDDCDKNEAYQASVEKAVQWTLDNQVLRKGDWSVKLPDVEPGGWAFEYA
NTFYPDTDDTAVALIVLSQFRDVEKWQEAGIEKAIERGVNWLFAMQSKNGGWGAFDKDNDNN
FITKIPFCDFGEALDPPSVDVTAHCIEAFGKLGLSRARPEIARGLDYLKSEQEADGAWFGRWGV
NYVYGTGAVLPALEAIGEDMSQPYIRKAANWLILRQNEDGGWGE >seq_ID 257
SPVWDTXLTLLALDDCDLNERQSKEVEKAVQWVLNQQVLRPGDWCVKVPKVQPGGWAFEYK
NYFYPDTDDTAVALIVLSQFRDDPKWQEKNIEQAIDRGLNWLIGMQCKGGGWGAFDKDNDKT
YLTKIPFCDFGEALDSPSVDVTAHIVEAFGKLGLGKSHPAMIRAIDYLKAEQEQDGAWFGRWGV
NYIYGTGAVLPALEAIGEDMRAPYIAKACDWLIAVQQEDGGWGE Enzyme Sequences >seq_ID 254
SPVWDTLLTLLAYDDSGQNERKADEVEKAVDWVLAXQVLRPGDWKVAPNLEPGGWAFEYA

NYFYPDTDDTAVALIVLSQFRNDAAWKEKGIEQAIEKGVNWLFGMQCKGGGWGAFDKDNDKQ

FLTKIPFCDFGEALDPPSVDVTAHIVEAFGKLKFSKDHPNIRRAIDYMKDEQEADGAWFGRWGV

NYIYGTGAVLPALEAIGEDMFAPCIGRACDWLVSRQNDDGGWGE

>seq_ID 255
SPVWDTLLTLLAYDNSGHNARKASEVEKAVDWVLAQQVLRPGDWNVKAPNLEPGGWAFEYA

NYFYPDTDDTAVALIVLSQFRNDAAWKDKGIEQAIEKGVNWLFGMQCKGGGWGAFDKDNDR

QFLTKIPFCDFGEALDPPSVDVTAHIVEAFGKLKFSKDHPNIRRAIDYTKDEQEDDGAWFGRWG

VNYIYGTGAVLLALEAIGEDMSAPYIGRACDWLVSRQNDDGGWGE

>seq_ID 256
SPVWDTLLTLLAIEDSGQSVKRAQEVEKAVDWVLSQQVLRPGDWKVRAPHLEPGGWAFEYAN

YFFPDTDDTAVALIVLSQFRNDAAWKAKGIETAIEKGVNWLLGMQCKGGGWGAFDKDNDKTYL

TKIPFCDFGEALDPPSVDVTAHIVEAFGKLGFSKDHPNIARAIEYLKSEQESDGXWFGRWGVNY

VYGVGAVLPALEAIGEDMSAPYIGRACDWLVSKQNSDGGWGE

>seq_ID 258
SPVWDTVLTMLAIHDCGADKQYAPQMDKAIDWLLANEVRHKGDWAVKLPDVEPGGWAFEYS

NACYPDLDDTAVALIVLAPYRNDPKWQARDIEGAVERAVDWTLAMQCKNGGWGAFGKDNDK

AILTKIPFCDFGEALDPPSVDVTAHVLEALAALGYDNSHPAVARAIRYLRDEQEPDGSWWGRW

GVNYIYGTAAVLPALKAMGVDMNEPFVHKAADWIGSVQNEDGGWGE

>seq_ID 302
SPVWDTSLVLVAMQEAGVPVDHPALVKAAQWLLDREVRLKGDWRVKSPDLEPGGWAFEFLN

DWYPDVDDSGFVMLALKDIKVRDKKQKSQAIKRGIAWCLGMQSANGGWGAFDKDNTKYLLNK

IPFADLEALIDPPTADLTGRMLELMGTFNYPKSHVAVVRALGFLKSVQEPEGPWWGRWGVNYI

YGTWSVLGGLDAIGEDMSQPYIRKAVNWLKSKQNLDGGWGEVCETYEDRSLMGCGPSTPSQ

TSWALLSLFSAGEINAKAVLRGIKYLVETQNQDGSWDEDAYTGTGFP

>seq_ID 271
SPVWDTAISVISLAXSGMERGHPALVRAAXWLMSKEIKTAGDWKVTNPAGPVGGWAFEFNNA

FYPDIDDSAMVMMALRHVHLDEHTAHRREKACLRGLNWLLSMQSRTGGWAAFDKDNTKVIMT

KIPFADHNAMIDPPWADITGRVLEFLGYIGYDQSYPAVARAARFLREEQEEDGSWFGRWGVNY

IYGTWQVLRGLAAIDEDMSQPYIRRAAEWLRSVQPPDGGWGETCATYHDPSLKGKGPATPAQ

TAWAVMGLMAAGIYDESVSRGIDYLVRTQRPDGTWDETEYGTGFP

>seq_ID 299
SPVWDTALVLVAMQEAGVPVDHPALIKSAQWLLDLEVRRKGDWHVKSPDLEPGGWAFESLND

WYPDVDDSGFVMLFIKDIKVRDKKLKDQAIKCGIAWCLGMQSENGGWGAFDKDNTKHLLNKIP

FADLEALIDPPTADLTGRMLELMGNFNYPKSHQAAVKALDFLKVEQEPEGPWWGRWGVNYIY

GTWSVLCGLEAIGEDMSQPYIKKAVNWLKSKQNLDGGWGEVCDSYADRSLMGCGPSTASQT

SWALLSLFAAGEVSSKAALRGVEYLLSTQKLDGTWDEDAFTGTGFP

>seq_ID 314
SPVWDTALAVRALAAAGVPPEHPAMVKASEWLLTQQIFKPGDWSIKCPDLPPGGWAFEFVNN

WYPDVDDSSMVLVALKDGLADAAKHQAALQRGINWCLGMQSKNGGFASFDKDNTKEWLNSL

PFGDLKALVDPPTEDITARILEMMGAFGHGLDHPVAARALAYLHQTQRPEGPWWGRWGVNYI

Enzyme Sequences

YGTWSVLVALKRIGEDMSRPYVRRAVDWVKAHQNPDGGWGEFCESYRNPELMGKGPSTAS

QTAWALLGLFAAGEVHAPEVTAGVDYLVKTQDSLGRWDEEQFTGTGFP

>seq_ID 251
SPVWDTVLTMLSVQDCDADENSENAPAIEKAIEWLLANEVRTGGDWQEKVKGVEPGGWAFEY

KNASYPDTDDTAVAMMALAPYRTEEKWKKKGLPEALKRAAEWNIAMQCSNGGWGAFDKDND

KTILCKIPFCDFGEALDPPSVDVTAHVLEGLAALDYPPEHPAIQRAVQFIKDEQEPDGSWWGR

WGVNFIYGTAAALPALKAVGEDMRAPYIDRAAKWIVDHQNEDGGWGE

>seq_ID 312
SPVWDTALAVRALAAAGVPPEHPAMVQASEWLLTQQIFKPGDWSVKCPDLPPGGWAFEFVN

NWYPDVDDSSMVLVALKDGLADAAKHQAALQRGINWCLGMQSKNGGFASFDKDNTKEWLNA

IPFGDLKALVDPPTEDITARILEMMGAFGHGLDHPVAVRAMAYLHETQRPEGPWWGRWGVNYI

YGTWSVLVALKRIGEDMSRPYVRRAVDWVKAHQNLDGGWGECCESYRNPELMGRGPSTAS

QTAWALLGLFASGEVHTPEVKAGVDYLVKTQNSLGRWDEEQFTGTGFP

>seq_ID 250
SPMWDTVLTTLAVQDAGVDQEPEFKPAMERTLEWLLKNEVRTGGDWQQKTRGVEPGGWAF

EYANASYPDNDDTAVALIVLAPFRHDPKWQARGIQHVIDRAVNWMFAMQCDNGGWAAFDLDN

DKAILTRIPFCDFGEALDPPSVDVTAHVLEALAALGYSREHPAVRRAIAFLKEDQEPDGSWFGR

WGVNFIYGTAAALPALKAMDEDMTQDWITRAADWMRSRQNDDGGWGE

>seq_ID 260
SPVWDTVLTLLAIQDADKQDDMAAEVDRAIGWLLSKEVRTNGDWSVKLPDVEPGGWAFEHEN

ARYPDTDDTAVAVMVLAPYRHHPKWRKRGLPEALDRAISWMRAMQCRNGGWGAFDKDNDN

AFLCVIPFCDXGEALDPPSIDVTAHALEAFAAMGFGPEDTTVARALDYMSKEQEADGSWWGR

WGVNYIYGTAAALPAYKAFGQDMRDFKLMKAADYLRAKQNADGGWGE

>seq_ID 259
SPVWDTVLTLLAMEDCEATEEHAAAIEQAIEWLLENEVRTPGDWQMKVPDADPGGWAFEYAN

AAYPDVDDTAVAILVLARYRDDPKWQAKGLPQAIDRAVAWVLAMQCSNGGWAAFDKDNDKSI

LCKIPFCDFGEALDPATVDVTAHVLEALAAVGYGPDHPAVRRGLDFLYAEQEADGSWWGRWG

VNYVYGTGAALPAFKAIGADMRDPRMLKAADWILRCQNKDGGWGE

>seq_ID 261
SPVWDTVLTLLAIQDADKQEEMAGEIDKAIGWLLSKEVRTKGDWSVKLPRVEPGGWAFEHENA

RYPDIDDTAVAIMVLAPYRDHPKWKKRGLPEALDRAIAWMRAMQCRGGGWGAFDKDNDKQIL

CTIPFCDFGEALDPPSIDVTAYALEAFAAMGYGPDDKTVARALKYMSKEQEADGSWWGRWGV

NYIYGTAAALPAYKALGQDMRDPGLMKAADYLRDKQNADGGWGE

>seq_ID 262
SPVWDTVLTLLAMQDADRTDKHKAAVDKAIQWVLDQEVRTPGDWCVQTPDVEPGGWAFEYE

NARYPDVDDTAVAIMVLAPYQDDPKWRKRGLPDALARAIAWIRAMQCKNGGWGAFDRDNDN

SMLTVIPFCDFGEALDPPSVDVTAHALEAFHMMGYGPEDPTVARALAYLDAEQEQDGSWWGR

WGVNFIYGTSAALPALKAMGRDMRDPRYTKAADYLRAVQNDDGGWGE

>seq_ID 275
SPVWDTLLALLALQDCDRELTAEMSRALDWVLANEVRYHGDWTKKVKGVEPSGWAFERANL

NYPDIDDTAVALIVLARLPRAWLDEPRIRATIDRVLGWTLAMQSSNGGWAAFDKDNDRPIITKIP

FCDFGEALDPPSADVTAHVLEALGLLGFDRRHPAVERGLRFLRSEQEADGSWFGRWGVNYVY

GTAAVLPGLAAIGEDMTQDYIRRANDWLIAHQNPDGGWGE

-continued

Enzyme Sequences

>seq_ID 280
SPVWDTLLSLVALQDCGKELTPARERALEWILGREIRTRGDWAKKVKNVEASGWAFERANLHY

PDIDDTAVALIMLARLPRAWLDQPRIRAVIDRALGWTLAMQSSSGGWAAFDKDNDRLIITKIPFC

DFGEALDPPSADVTAHVLEALGILGFDRQHAAVRHGLKFLRSEQEADGSWFGRWGVNHVYGT

GAVLPALAAIGEDMAQDYVRRAADWLVAHQNADGGWGE

>seq_ID 277
SPVWDTLLALLAMQDCERELTPQMERALDWVLANEVRYYGDWSKKVRGVEPSGWAFERANL

NYPDIDDTVVALIVLARLPRALLDQPRIRAVIDRALGWTLAMQSSNGGWAAFDKDNDHLIITKIPF

CGFGEALDPPSADVTAHVLEALGLLGFDRHHPAVARGYQFLRKEQEADGSWFGRWGVNHIY

GTAAVLPALAAIGEDMSQPYIRAAAEWIIAHQNADGGWGE

>seq_ID 300
SPVWDTALVLVAMQXAGVPVXHPALVKSAQWLLDLEVXXKGDWQVKSPELEPGGWAFXFLN

DWYPDVDDSGFVMLSIKXIKVRDKKHKEQAIKRGISWCLGMQSDNGGWAAFDKNNTKYLLNKI

PFAXLEALIDPPTAXLTGRMLELMGNFNYPKTHKAAVQALEFLXMEXEPXGPWWGRWGVNYIY

GTWSVLCGLEAIGEDMAQPYIKKSINWLKSKQNMDGGWGEVCESYGDRSLMGCGPSTASQT

SWALLSLFAAGEVHSKAATRGIEYLLATQKLDGTWDEDAYTGTGFP

>seq_ID 279
SPVWDTLLXLLAMQDCERESTPSMERALDWXXANEVRYYGDWSKKVRGVEPSGWAFXRANL

NYPDIDDTDVALIVLARLPRALLDQSRVHAVIDRALGWTLXMQSSNGGWAAFDKDNNHLIITKIP

FCDFXEALDPPSADVTAHVLEALGLLGFNRNHPAVERGYRFLRSEQETDGSWFGRWGVNHVY

GTXAVLPALAAIGEDMTQPYIRSAAEWIIAHQNADGGWGE

>seq_ID 264
SPVWDTLLTLEALLDCNLSPKTFTGMQAAVDWILSKQIVTPGDWQIKVPGVSCGGWAFERANT

FYPDMDDTAVAMIVLARIRRYYNDSSRIDRALACATDWILSMQCSNGGWAAFDLDNTNDLVTRI

PFSDFGEMLDPPSVDVTAHVVEALGCLGRTRNDPAVARAVAYILDEQEPEGSWFGRWGVNHI

YGTGAVLPALAAVGTDMSAGYITRAADWVATHQNADGGWGE

>seq_ID 19
GGWMFQASISPIWDTGLTVLALRSAGLPPDHPALIKAGEWLVSKQILKDGDWKVRRRKAKPGG

WAFEFHCENYPDVDDTAMVVLALNGIQLPDEGKRRDALTRGFRWLREMQSSNGGWGAYDVD

NTRQLTNRIPFCNFGEVIDPPSEDVTAHVLECFGSFGYDEAWKVIRKAVEYLKAQQRPDGSWF

GRWGVNYVYGIGAVVPGLKAVGVDMREPWVQKSLDWLVEHQNEDGGWGE

>seq_ID 278
SPVWDTLLSLLAMQDCERGFTPSMERALDWVLANEVRYYGDWSKKVRGVEPSGWAFERANL

NYPDIDDTAVALIVLARLPRAQLDQPRIREVIDRALGWTLAMQSSNGGWAAFDKDNDHLIITKIP

FCDFGEALDPPSADVAAHVLEALGLLGFERKHPAVERGLKFIRSEQEADGSWFGRWGVNHIY

GTAAVLPALXAIGEDM

>seq_ID 315
SPVWDTALAVRALAAAGLPPDHPFMTQATSWLLTQQIFKPGDWCIKCPDLPPGGWAFXFHNN

WYPDVDDSSMVLVALKDGLPDTARHQAALQRGINWCLGMQSKNGGFASFDKDNTKEWLNAL

PFGDLKALVDPPTEDITARILEMMGAFGHGLDHPTADRALAFLRRTQHPEGPWWGRWGVNYL

YGTWSVLVALKRIGXDMSRPYVQRAVNWIKSHQNPDGGWGEVCESYRHPELMGQGPSTASQ

TAWALLGLLAAGEIQAAEVKAGVDYLVKTQNAQGRWDEKYFTGNWLP

-continued

Enzyme Sequences

>seq_ID 297
SPVWDTALVLQAMQEASIPLDHPALVKAAQWLLDREVRIKGDWKIKSPGLEPGGWAFEFQND
WYPDVDDSAAVLIAIKDIQVKNNKAKQGAVRRGIDWCLGMQSKNGGWGAFDKDNTKHLLNKIP
FADLEALIDPPTADLTGRMLELMGNFGYDKHHPQAVHALEFLKKEQEPEGPWFGRWGVNYIY
GTWYVLIGLEAIGEDMNQPYIKKAANWIKSRQNIDGGWGE >seq_ID 17
QASISPVWDTGLAVLALRAAGLPADHDRLVKAGEWLLDRQITVPGDWVVKRPNLNPGGFALQF
DNVYYPDVDDTAVVIWALNTLRLPDERRRDAMTKGFRWIVGMQSSNGGWGAYDVDNTSDL
PNHIPFCDFGEVTDPPSEDVTAHVLECFGSFGYDDAWKVIQRAVAYLKREQKPDGSWFGRWG
VNYIYGTGAVVSALKAVGIDMREPYIQKALDWVEQHQNPDG >seq_ID 303
SPVWDTALVLVAMQEAGVPLDHPALVKAAQWLLDREVRIKGDWRIKSPDIEPGGWAFEFLND
WYPDVDDSGFVMLAIKDVKVRDKKKKEQAIKRGINWCLGMQSANGGWGAFDKDNTKYLLNKI
PFADLEALIDPPTADLTGRMLELLGTFNFPKDHHAIERALEFIQLEQEPEGPWWGRWGVNYIYG
TWSVISGLEAIGEDMSQPYIRKTVNWLKSKQNMDGGWGE >seq_ID 298
SPVWDTTLVLVAMQEAGVPVDHPALVKSAQWLLDLEVRRKGDWQVKSPDVEPGGWAFEFMN
DWYPDVDDSGFVMLAIXNIRVRDKKHQEQAIKRGIAWCLEMQSENGGWGAFDKDNTKYLLNKI
PFADLEALIDPPTADLTGRMLELMGNFDYSASYPAAVRALEFLKKEQEPEGPWWGRWGVNYIY
GTWSVLCGLEAIGEDMSQPYIRKAVNWLKSKQNLDGGWGE >seq_ID 301
SPVWDTALALVAMQEAGVPKDHPALVKAAQWLLDLEVRRKGDWQIKSPELEPGGWAFEFLND
WYPDVDDSGFVIMAIRDIKAPDKKHKEQAIKRGIAWCLGMQSKNGGWGAFDKDNTKHLLNKIP
FADLEALIDPPTADLTGRMLELMGSFDYPMDHPAAARALEFLKKEQEPEGPWWGRWGVNYIY
GTWSVLCGLESIGEDMSQPYIKKAVNWLKSKQNMDGGWGE >seq_ID 276
SPVWDTLLTLLAMEDCDRGLTPSMQRALEWVLAQEVRYAGDWSKKVKGVEPSGWAFERANL
NYPDIDDTAVALIVLARLPRAWLDEPRIRATIDRVLGWTLAMQSSNGGWAAFDKDNDRPIITKIP
FCDFGEALDPPSADVTAHVLEALGLPGFDRRHPAVERGYKFLRSEQEADGSWFGRWGVNHIY
GTAAVLPALASIXEDM >seq_ID 283
SPVWDTCLTSNALVESGGDTSAPHVHRSVQWLLNQEIRNHGDWSVKAPKVGPSGWAFEFAN
KVYPDVDDAAEVIIALANYSNDSGTAPPDAIARGVRWISGMQSSNGGWGSFDKNNTSFFVTRL
PFFDFGEVIDPPSVDVTAHVIEALAVAGWQEKASKQIQKALDYIWSEQEADGPWFGRWGINYIY
GTCAVLSALEAIGYDMADARVVKALKWIEECQNADGGWGE >seq_ID 307
SPVWDTPWMIEALLETGVPPGDPALLRAGRWLMSKQITGVRGDWAMKSPKGKPGGWAFEFE
NDYYPDVDDTIQVLTALCKLSIPWREKEKAVMQGIDWLISMQNDDGGWGAFDRNQTRWIVNRI
PFSDHKACLDPSSPDITGRMVEFLMRRNYSTSHPSVKKALKYIRETQEDFGAWFARWGINYIY
GTWCVLTALAAMGIGHTDSRVAKAVAWLSSVQRPDGGFSEAADTYHPHKPFESYSESVPSQS
AWALMGLVAGGAVHSPAAARAACYLINNRNLNNGWDERHYTGTGFP

Enzyme Sequences

>seq_ID 267
SPVWDTAISVIALAESGLHRGHPSLVQATEWLVANEIRRGGDWQVKNPTAPISGWAFEFKNDF
YPDVDDTAMVLLALRHVHLYNDDVSQDREKSYLRGLNWMLSMQCKNGGWAAFDRDNVKTIF
EKIPFADHNAMIDPPSVDITGRVLELLGYVGYDKSYPCVTKALEYIKKDQEADGSWYGRWGVN
YIYGTWQVLRGLAAIGEDMQSEYVQKAVRWMKSVQNPDGGWGE >seq_ID 309
SPVWDTVLSITALADADLPRTHPAMRRAVAWVLGKQVLCEGDWRVKNRRGEPGGWSFEFNN
NFYQDNDDTAAVLIALHKARLPDEAKGEAMQRGLRWLLSMQCDDGGWSAFDVNNNKRLLNKI
PFADLESMLDPSTCDLTGRTLEALGSIGFPFTHRIVQHAVRFIRQHQEADGAWYGRWGVNYIY
GTCHVLCGLLSVGEDMHQPYVQRAVQWLIEHQNADGGWGE >seq_ID 202
MVYSYEMMVLLDYPEDHPLRVECKAALKKLVVHRDDGSSYCQPCLSPVWDTAWSVMALEQA
PSDARTETAIARAYDWLTDRQVLDLRGDWENNAAPSTPPGGWAFQYENPYYPDIDDSAVVLA
MLHARGKRTGQPGRYEMPVARCLDWIIGLQSRNGGFGAFDANCDRDFLNAIPFADHGALLDP
PTEDVSGRVLLALGITERPQDATARERCIQYLRDTQQPDGSWWGRWGTNYIYGTWSVLAGLG
LAGVDRKLPMVRNGLQWLRGKQNADGGWGETNDSYARPELAGKHEDGSMAEQTAWAMLG
QMAVGEGDADSVHRGAAYLLDAQNEDGFWMHPYHNAPGFPRIFHLKYHG >seq_ID 306
SPVWDTPWTVMALLEAGVPSNDPALLRSGRWLLAKQITDTKGDWAIKNKNTAPGGWSFEFEN
KYFPDVDDTIEVLHCLHKLAIPWREKEKPCRLGIDWLLSMQNDDGGWGAFDKNQKRQVVNRIP
FSDHGACLDPSSPDITGRMIEFLATQKFNSEYESVKRALKYIWKTQEDFGGWHARWGINYIYGT
WCVLTGLRAIGFNMTDRRVQKALNWLESIQNKDGGFGESPASYEECRYIPWKESVPSQTAWA
LMALVAGGGAGSAPAENAATFLINYRNSNGVWDEECYTGTGFP >seq_ID 281
SPVWDTLLTLLAYQDCELEMNDSAGRALDWILSQENSYRGDWAHRNKKLEPSGWAFERANLH
YPDIDDTSVALIVLARLPQAVRSRPDIKSAIDRALAWTLGMQCRNGGWAAFDRDNDKLIITMIPF
CDFSEALDPPSADVTAHVVEAMAHLGFDRSHKAVEKAYQYLLAEQEDDGSWFGRWGVNHIY
GTAAVLPALAALGEDATVPHVKRAADWISAHQNTDGGWGE >seq_ID 310
SPVWDTALAVRALAAAGLPPEHPAMVKASEWLLTQQIFKPGDWSVKCPDLPPGGWAFEFVNN
WYPDVDDSSMVLVALKEGLADAAKHQAALQRGINWCLGMQSKNGGFASFDKDNTKEWLNAIP
FGDLKALVDPPTEDITARILEMMGAFGHGLDHPVAVRGLAYLHQTQRPEGPWWGRWGVNYIY
GTWSVLVALKRIGEDMSRPYVRRAVDWVKAHQNPDGGWGE >seq_ID 311
SPVWDTALAVRALAAAGLPPEHPAMVKASEWLLTQQIFKPGDWSVKCPDLPPGGWAFEFVNN
WYPDVDDSSMVLVALKDGLVDAAKHQAALQRGINWCLGMQSKNGGFASFDKDNTKEWLNAI
PFGDLKALVDPPTEDITARILEMMGAFGHGLDHPVAVRALAYLHQTQRPEGPWWGRWGVNYI
YGTWSVLVALKRIGEDMNRPYVRRAVDWVKAHQNLDGGWGE >seq_ID 290
SPIWDTAKAVNALHESGLPSDHPQLKAAARWLVEKEVRKPGDWKMRVPHVDVGGWPFQFRN
EFYPDVDDTAAVVMALGRVDERDVPGIKDSITRGINWVTQMQCSCGGWAAFDVDVKREFLTK
VPYADHNAMLDPPCPDITGRCLEMYGRFPGVRKDADVQRVIEKGIEYLKKTQEPDGSWYGRW
GVNYIYGTWQSLKGLAAVGEDPSQPYIQKAAHFLKTHQNSDGGWGE

Enzyme Sequences

>seq_ID 292
SPVWDTAKAVNALHESGLPSDHPQLKAAARWLVEKEVRKPGDWKMRVPHVDVGGWPFQFR
NEFYPDVDDTAAVVMALGRVDERDVPGIKDSITRGINWVTQMQCSCGGWAAFDVDVKREFLT
KVPYADHNAMLDPPCPDITGRCLEMYGRFPEVRKDANVQNVIAKGIEYLKKTQEPDGSWYGR
WGVNYIYGTWQSLKGLAAVGEDPSQPYIQKAAHFLKTHQNSDGGWGE >seq_ID 293
SPVWDTCLSLAALTEAGAQNDHPAVKQAVEWLLDHQIFVEGDWCAQASGLEPGGWAFQYEN
DKYPDVDDTGMVLMSLLRAGVHDKEHKRKRVNQALNWVLGMQNPDGSWGAFDIENNYEYLN
KIPFADHGALVDPGTADLTARCVELLAMLGYDATFPPVKRALEFLEHDQEEDGSWYGRWGVN
YIYGTWSVLCALGAIGEDVAKPYVRKSVQWLQDTQNEDGGWGE >seq_ID 313
SPIWDTALAVRALTAAGMPPEHPAMVKASEWLLTQQIFKPGDWSVKCPDLPPGGWAFEFVNN
WYPDVDDSSMVLVALKEGLADTAKHQAALQRGINWCLGMQSKNGGFASFDKDNTKEWLNAIP
FGDLKALVDPPTEDITARILEMMGAFGHGLDHPVAVRALAYLHETQRPGGPWWGRWGVNYLY
GTWSVLVALKRIGEDMSRPYVRRAVDWVKDHQNLDGGWGE >seq_ID 304
SPVWDTPWMVMALLEAGVPTDXPGLLRAGRWLISKQITGVHGDWAVKNRHALPGGWSFEFE
NDYFPDVDDTIEVLHVIHRLAIPWEEKSECCRLGLDWLLSMQNDDGGWGAFDRNQTLVMVNRI
PFSDHAACLDPSSPDIVGRVLEFLASRSFSREHPAVKRALDYIWREQSPFGGWWARWGIDYLY
GTWCVLTGLRAIGWDMEDPRVRKAVAWLESVARPDGGYGESPESYRDHSYVEWKRSVPSQT
AWALMGLVAGGVGHGKAARGAADYLLTSRNAQGGWDEMDYTGTGFP >seq_ID 291
SPMWDTAKAVNALHESGLPSDHPQLKAAARWLVEKEVQKPGDWKMRVPYVDVGGWPFQFR
NEFYPDVDDTAAVVMALGRVDERDVPGIKDSITRGINWVTQMQCSCGGWAAFDVDVKREFLT
KVPYADHNAMLDPPCPDITGRCLEMYGRFPEVRKDVDVQRVIEKGIEYLKKTQEPDGSWYGR
WGVNYIYGTWQSLKGLAAVGEDPSQPYIQKAAHFLKTHQNSDGGWGE >seq_ID 318
SPVWDTGLALHALLESGMDPDDPAIAKAMHWLDEREITDVAGDWAEQRPGLAPGGWAFQYR
NDHYPDVDDTAVVGMAMHRANPQARPETLERTRAWIEGMQSQNGGWGAFDADNTHYHLNHI
PFADHGAMLDPPTADVSARCLGMLSQMGYDRDHPSIQRAIAYLKNDQEEDGSWFGRWGTNYI
YGTWSVLSALNAAGEDMSQPYIRKAVDYLTNFQREDGGWGE >seq_ID 294
SPVWDTCLSLAALTEAGAQNDHPAVKQAVEWLLDHQIFVEGDWCDQAPGLEPGGWAFQYEN
NKYPDVDDTGMVLMSLLRAGVHDKEHKRKRVNQALNWVLGMQNPDGSWGAFDIENNYEYLN
RIPFADHGALVDPGTADLTARCVELLAMLGYDATFPPVKRALEFLEQDQEEDGSWYGRWGVN
YIYGTWSVLCALGATGEDVAKPYVRKSVQWLQDTQNEDGGWGE >seq_ID 320
SPVWDTCLGLHALLEAGEPREAPSVKKAVDWLLEREITETYGDWVWRRPHLKPSGWAFQYW
NNYYPDVDDTAVVVMALDRVGDPRCRPAIERACEWIIGMQSTSGGWGSFDPENEFTYLNHIPF
ADHGALLDPPTVDVTARCISMLAQVGYRHDHPAIRKSVXFILREQEKDGSWYGRWGTNYVYG
TWSALSALNAVGEDMSSPVVRKGVAWLEAFQQPDGGWGE

Enzyme Sequences

>seq_ID 295
SPVWDTCLSLTAMTESGAHPEHPAVKQAVEWLLDQQIFVKGDWADQAKNLEPGGWAFQFEN

DRCPDVDDTGMVLMALLRAGVQDKEHKIKRINQAVNWVLGMQNPDGSWGAFDIGNDHEYLN

NIPFADHGALVDPGTADLTARCVELLAMLGYGPDFPPIQRAVAFLERDQEEFGAWYGRWGVN

YIYGTWSVLSAIGILGEDYAKPYVRKAVEWLKEIQNDDGGWGE

>seq_ID 324
SPVWDTSLAAHALLEAGEPNDPEVIGLLDWLKDKQILTTVGDWSARRPNLRPGGWAFQYENP

HYPDVDDTAVVAMAMHRQGDPKYAEAIARACEWLAGMQSSSGGWGAFDPENEHFYLNSIPF

ADHGALLDPPTVDVTARCVGCLAQVDAERFASEIQAGIDYIKREQEEDGSWFGRWGANYVYG

TWSALVALNKAGEDMNTPYIRRAVDWLKARQRPDGGWGE

>seq_ID 296
SPVWDTCLSLNALTEADMPANDPRVRAAVQWLFDRQIFVRGDWSENAPELEPGGWAFQYEN

DKYPDVDDTGMVLMSLLRANAHEHDAQRKRMNQALNWVLGMQNSDGSWGAFDIDNHYTYL

NNIPFADHGALVDPGTADLTGRCIELFGMLGYDKNFTPARRGIEFLKRDQHPCGGWYGRWGV

NYLYGTWSVLTALGAIGEARDAPYLRRAVEWLYSVQNDDGGWGE

>seq_ID 305
SPVWDTPWMVMALLEAGCPANDPXLIRAGRWLKAKXITEVRGDWAVKNRKALPGGWSFEFE

NDYFPDVDDTIEVLSVIHRLSIPWNEKAKSCRLGLEWXLSMXNRDGGWGAFDREQXFKVVNRI

PFSDHAACLDPSSPDITGRMVEFLASXNFSKGHVAVRRALDYIWKQQAXFGGWWARWGIDYL

YGTWCVLTGLASLGFXMDDPRARKAADWLESIQHADGGFGESPESYREDSFVDWKRSVPSQ

TAWALMGLVAAGRASGAAAQRAAAWLLDNRNTNGSWDEQDYTGTGFP

>seq_ID 282
SPMWDTSLAAHALMEADGRGDPKDNPRLISAMDWLADKQILDHVGDWAVRRPDVRPGGWAF

QYENPDYPDVDDTAVVVMAMHRADPERYEMSIDRACEWLVGMQSKNGGWGAFEPENEHYY

LNSIPFADHGALLDPPTVDVTARCVGALAQVDRDRYAAEIANGIRSIRREQEDDGSWFGRWGA

NYVYGTWSALVALKGAGEDMQQPYIRRAVDWLKARQRSDGGWGE

>seq_ID 316
SPVWDTAWAVIGLCESGMERTHPAVRSAIRWLYSMQILRPGDWAVKNPLTEPGGWAFEFHND

FYPDNDDTAAVLMGLLFSDLNDEENHRAFERGVRWLLSMQNNDSGWGAFERNVDNKIFDQIP

FNDQKNMLDPSTADVTGRVVELLGRIGRRLGGSFSDEPYVRQAIEFLKNEQEPEGCWFGRWG

VNYIYGTWSVLVALEAIGESMRAPYIRKAVNWVKKVQNPDGGWGE

>seq_ID 266
SPIWDTGIVLHSLVESGVSPDHEALLRSVSWLLAKEVTHEGDWKVKCPDAPVGGWYFEYANE

FNPDCDDTAKVLMATSRFSSVDFPDAGRLRDARNRGLQWLLHMQNKDGGWAAFDKGCDNEL

LTYIPFADHNAMIDPSTEDITGRVLETLAREGFDNTHPVVKRAIQYLHKTQDAEGPWYGRWGS

NFIYGTWLVLQGLKAVGEDMTXPRYQRAANWLLNVQNXNGSWGE

>seq_ID 323
SPMWDTSLAAHAFLESGDREDPRLIRALDWLVDKQILDHVGDWAVRRPGLRPGGWAFQYEN

PDYPDVDDTAVVAMAMHRTDPERYAENIDRACEWLAGMQSKNGGWGAFDPENEHYYLNSIP

FADHGALLDPPTVDVTARCIGCLAQVDAEAFADNIKRGIGFIKREQEPDGSWFGRWGANYIYGT

WSALVALKGAGEDMSQPYIRKSVAWLKGRQGPDGGWGE

-continued

Enzyme Sequences

>seq_ID 274
SPVWDTILSMQALLDTKEVFQPSPTLKKAMEWLLEQQVRAWGDWKVYVSDARGGWAFQRA
NSFYPDVDDTIMVMMALRNVSPRGESKVVDEAIERALFWVLGMQCEDGGWAAFDRDNAKAFL
TKVPFADHNAMIDPSTADLTSRTFEMFAMIAPEVFTIHHPVVRRGLEFLKKDQCKDGSWFGRW
GVNYMYGTWQVLRGLRLIGEDMSKGYVRKGVEWFKSVQLEDGGWGE >seq_ID 284
SPVWDTVAQLHALIASGLARRDEALRRAASWLLTRQSRTHGDWSGRNPAEPGGFYFEFRNEF
YPDVDDTAMALMVLTQAEANVATDVQHAAIARALAWMLGMQNRDGGWAAFDRDNDKHFLTQ
VPFADHNAMIDPSTADITGRVLGALSHVPSYGPDHPSVRRAIAFLQRDQEPDGSWYGRWGVN
YLYGTGQVLRGLRAIGFDMQQPFVRRAARFLSAHQNDDGGWGE >seq_ID 285
SPVWDTAITIIALAESGLPKNHPAFEQAATWLEKKEIRFKGDWAVRMPGVEPSGWAFEHENKY
YPDTDDTMMVLMALRHVQSRNSAERCEQFDRALKWLLAFQCQDGGWAAFDKDVTASWLEH
VPFADHNAILDPTCSDLTARVLELLGSISFDRQSAIVRRAVAMMRRTQETDGSWYGRWGVNYI
YGTWQALRGLAAIGENMDQEWIRRGRDWLESCQNDDGGWGE >seq_ID 308
SPVWDTAIAGYALGESGCAPQSALRRMADWLLTKEVRRKDDWSVKRPDVEPSGWYFEFANE
FYPDTDDTAMVLLSLLHGRATNPAAQEACAKRAVNWLLAMQSKDGGWAAFDVDNDWKPLSY
VPFADHNAMLDPSCPDITGRVLEALCKYGVSQEHPAVLRAIDYLIQTQEQDGSWHGRWGVNY
VYGTFLALRGLKAAGVSDREAYVLRAGEWLDLIQNPDGGWGE >seq_ID 288
SPVWDTAITAVSLAESGLEPDHPALQKSAEWLLDKEVRIQGDWAIKNRHGEASGWAFEFNNEF
YPDVDDTLKVLLALRLIKTRDEETKREAMERALGWVMSFQCSDGGWAAFDKDVTQRWLEDVP
FADHNAILDPTCSDITARCLELLGKMGCTSDHPAVRRALRMVRETQEPDGTWWGRWGVNYIY
GTWQILRGLSALKIDMNQDWIVRAKEWLESCQNPDGGWGE >seq_ID 287
SPVWDTAITSVALTSSGVKPDHPQIQKAADWLLDREVVMRGDWKVKNPYPHASGWAFEFNND
FYPDADDTFKVLLALMKMKSSDPERQRKIMDRALDWARSFQCKDGGFAAFDKDVTKKWLEHV
PFADHNAILDPSCSDITARGLECMGKLGWPRTDRVIRRAIRYLKKTQEEDGSWWGRWGVNYIY
GTWQSLRGLEAIGEDMNQDWVVRARNWLESCQNPDGGWGE >seq_ID 289
SPIWDTAIVTMAIAESGQDPNDPRLQKAADWLLEREIGFRGDWRENCDFPEATGWAFEFNND
WYPDVDDTFQVILGLKPLSASDSRRQEQTLDRAIRWCRAMQCREGGFAAFDKDINDAWLNEV
PFADHNAILDPPCSDITGRALETLSLMGFDREDPVVRRARQYLMETQLEDGSWFGRWGVNYIY
GTGHALRGLHAIGEDINGSAMQRARNWLENCQNDDGGWGE >seq_ID 286
SPVWDTAINVISLAESGLLSDHPALQKAADWLVNKEVRFRGDWSVNNSYPQVSGWAFEYNNV
YYPDTDDTAMVLMALRLIRPKDPQALNELFRRALDWQLSFQCRDGGWAAFDKNVTTPWLEDM
PFADHNAILDPTCSDLTARTLELLGYTGFDPKAQSVRDALQYLIDTQDEDGSWYGRWGVNYIY
GTWQVLRGLRAMGQDMTQDWILRGRDWLESCQNSDGGWGE >seq_ID 270
SPVWDTALAMSALLEGDTAPDDEALQRGCRWLLGKEVRHRGDWQVNVGAEPGGWFFEYEN
EFYPDCDDTAEVLAVLERVRLSDPEEDQRRRDALDRALAWQLGMQSTNGGWGAFDKDCDHR

Enzyme Sequences

ILELVPFADHNAMIDPPTVDVTSRSIEAALAMGVPASDAAIRRAVRFLYSEQEADGSWYGRWG

SNYLYGTWLALCALRSAGEDLTSPAVQRAVEWLLSVQQEDGGWGE

>seq_ID 322
SPVWDTGIAAHALGEAGHASAMQSTADWLLTKEVRRKGDWSVKRPDVEPSGWYFEFANEFY

PDIDDTAQVLLGLAHAKASDPAKQKACMDRAVAWLLAMQGSDGGWAAFDVDNNWEFLSSVP

FADHNAMLDPTCPDITGRVLEALAACGVPNSHPAVKRGVEFLRNSVEKDGSWYGRWGVNYIY

GTYLALRGLRASGEDDREAHILRAGEWLRAIQNADGGWGE

>seq_ID 263
SPVWDTSLILNALLAGSEKTETDPKILKAGQWLLDREVREIGDWKIKNNRGPVGGWYFEYANE

FYPDCDDTAEVITVLNQMQFSDPEKEKAKQVAQQRGLDWLLSMQNKDGGWPAFDKNCDKQS

LTYMPFADHNAMIDPSYEDITGRTLEALASLGFSEDDPIVRRAVDFLKSKQLPDGTWYGRWGC

NFLYGTWLAISGLYHAGEDLNEERYQSLLSWLEQCQNEDGGWGE

>seq_ID 268
SPVWDTCLILNSMLEHLEPDHPRVQKAAEWLLSKEVTEPGDWQVKCPEAPVGGWYFEYANEF

YPDCDDTAEVLAALQRVQFTDADREAQKRGAIQRGLGWLLAMQNQDGGXAAFDRECTREALT

YVPFADHNAMIDPSNGDITGRVLKALDYAGYSPDDPIVRGGVDFLLANQEPDGTWYGRWGCN

HLYGSWLVVWGLKHAGVNLQQTQFTQVMSWLESCQNADGGWGE

>seq_ID 265
SPVWDTTNAMTAVLDAGLPGNHPAVLRAARWLLSKEVRMPGDWRLWYKNGEPGGWFFEYN

NEFYPDADDTAEALHCLCRVVFDCEDEMDRCRAAIKRGLNWQFACQNPDGGWPAFDKECDD

EYLTFIPFADHNAMIDPSCCDITGRSLQALSKLGYTTNDVDVKRAIDYLLDAQEDDGTWYGRWG

INYIYGTWLAVQGLRAIGVDLSEKRFQKVTKWLRKKQNPDGGWGE

>seq_ID 269
SPVWDTCLILNSLLEHLEPDHPRLQHAAEWLLSKEVTEPGDWQVKCPEAPIGGWYFEYANEFY

PDCDDTAEVLAALQRVRFSDADREAQKHAAIERGLGWLLAMQNGDGGWAAFDRECTREALT

YVPFADHNAMIDPSNGDITGRVLKALDYSGRSPQDPVVQGGVHFLLANQEPDGTWYGRWGC

NHLYGSWLAIWGLKHAGVDSQQSQFMRLLSWLESCQNPDGGWGE

>seq_ID 319
SPVWDTSLSAHALMEAGLEENDKRLEGLLDWLKDLQILDVKGDWVARRPDVRPGGWAFQYR

NDHYPDVDDTAVVAMAMHRQGDEKYKEAIDRAAEWIVGMQSSSGGWGAFDPENEHFYLNSI

PFADHGALLDPPTEDVTARCVGFLAQLDPDAYAEPIKRGVEFLKRTQQEDGSWWGRWGANF

VYGTWSVLCALNAAGEDPKSPYIQKAVAWLKSRQREDGGWGE

>seq_ID 321
SPVWDTGIACQALQEVGGPAADAGVQRALDWLVERQLRDEPGDWRRDRPDLEGGGWAFQY

NNPHYPDLDDTSMVAWVMQVADHGRYREEIRRAAKWVVGMRSEGGGFASFEVDNTYYYLNH

IPFADHGXLLDPPTXDVTARCIAVLAITDRAQHETVIREAIDFLFVDQEEDGSWFGRWGTDYIYG

TWSVLSXLDVVGFDMRDARVRXSVEWLFXQQNPDGGWGE

>seq_ID 272
SPVWDTGLVALALQEVDKHNSQDALQRNLKQAYSWLLSKQLKDEPGDWRISKPTLTGGGWAF

QFNNPHYPDVDDTAVVAFALAQAEHTELDESIHLATRWIEGMQSQNGGYGAFDVDNTFYYLNE

IPFADHGALLDPPTADVSARCAMLMARVAKDHEEYLPALERTIQYLRSEQEADGSWFGRWGT

NYVYGTWSVLLGLEQTNVPKTDPLFTKAAQWLKSVQRPDGGWGE

-continued

Enzyme Sequences

>seq_ID 273
SPVWDTGLVALALPEVDKHNSQDALQPNLKQAYSWLLSKQLKDQPGDWRISKPTLTGGGWAF

QFNNPHYPDVHDTAVLAFALAQAEHTELDESIHLATRWIEGMQSQNGGYGAFDVDNTFYYLNE

IPFADHGALLDPPTADVSARCAMLMARVAKGHEEYLPALERTIQYLRSEQEADGSWFGRWGT

NYVYGTWSVLLGLEQTNVPKTDPLFTKAAQWLKSVQRPDGGWGE

>seq_ID 317
SPVWDTILGMIGLVDCGHDGKDPLLVTARDWIVKRQLLVNYGDWKVYNPNGPSGGWSFEYDN

SWYPDVDDTAAIVIGFLKQDYEFRHSEVVKRACDWIASMQNQXGGWAAFDINNDKTFLNEIPF

SDMESLCDPSSPDVVGRVLEAFGILNDPKYAEVCRRGIEYLRRTQESEGSWFGRWGVNYVYG

TSNVLCSLKRQDVAXKDPMVTRALTWLKKVQNKDGGWGE

>seq_ID 215
MGRQTRNLTRREPAAEAEERGFRLLDAHRRADSSWVGELSSSALATAMSALALRLLGHPAES

GPVAGGLAWLAATRNPDGGWGDAPGEPSNMNATSIAAAALARCAPRRYREEVAGGRRWVE

EHGGFAALNDPRTTTLSGPGRTLWALAGLVPPERVRKLPTEMILLPRRIRRTVSTTFPAFLSLSL

LHERFRFSPRWRRPLRRRAEREALAWLRRAQGPNGSYEESAFLTSLIAAALTAAGAEGGDIVR

RALPFVLRSRRPDGSWPIDRDLENFDTTQAILAHHEAGRPLREAGRVREWLLDNQFRRPFFPT

SSPPGGWAWAYPAGWPDTDDTACALRSLRLLGVPAGHPSIRLGLRWLYRMQNRDGSWPTFV

RGSRMPFDHGCPYITSQVLSALALMGPEARRGAPLRRALAYLRRAQRPDGSLGSLWFRPHTR

GTAAAVEAFSDLGLSGDPLVGRAARWLAEHQNPDGGWGDGHGAPSTAEETAWASAALLRLG

GGEAARKGVRWLVEHQDPGGWKPAVIGLYYASLSYSDTFYALSYPLVALARHRRLSR

>seq_ID 191
MIKKILVLILLMVVVTSKVDIERVQTVIRDAREICWNELTDNEWVYPTYLGTLFLSEYYFELKALGI

QNSQFEESKFTQILLGSQLPDGSWVQVEDAYIQTGQLDATIFNYWYLKAVGIDIHTDTMKKAQE

WIKANGGIEKAQTMTKFKLAMFGQYPWKKLFKIPLILFYKKFNPLYIKDITAQWVYPHMTALAYL

QNQRIIFNVAVSISELYKNKAPKIKNHQKKGRPSFFINNLVQEMLKLRQPMGSFGGYTVSTLLSM

LALNDYTGRTNKHKSEISDALKKGLDFVEFNYFNFRQAYHGSLDDGRWWDTILISWAMLESGE

DKEKVRPIVENMLQKGVQPNGGIEYGYDFGYAPDADDTGLLLQVLSYYGTDYADAMDKGAEF

VYSVQNTDGGFPAFDKGKMGKNPLYKYAFKIAGIADSAEIFDPSSPDVTAHILEGLISSDRSNYD

VVVKSLKYFMDTQENFGSWEGRWGINYIYAAGAVLPALKKMNNGWAKAVNWLVSKQNADGG

FGETTLSYRDPKKYNGIGVSTVTQTSWGLLGLLAVEDHYDVKEAIEKARDGEFKDISVVGTGHR

GLLYLQYPSYARSFPVISLGRFLDQQR

SEQUENCE LISTING (388 sequences)

SEQ ID NO: 1 - DNA, 2178 bp, Zymomonas mobilis
atgggtattgacagaatgaatagcttaagtcgcttgttaatgaagaagattttcggggctgaaaaaacctcgtataaaccggcttccgataccataatcggaacggataccctgaaaagaccgaaccggcggcctgaaccgacggcaaaagtcgacaaaacgatattcaagactatggggaatagtctgaataatacccttgtttcagcctgtgactggttgatcggacaacaaaagcccgatggtcattgggtcggtgccgtggaatccaatgcttcgatggaagcagaatggtgtctggccttgtggtttttgggtctggaagatcatccgcttcgtccaagattgggcaatgctcttttggaaatgcagcgggaagatggctcttggggagtctatttcggcgctggaaatggcgatatcaatgccacggttgaagcctatgcggccttgcggtctttggggtattctgccgataatcctgttttgaaaaaagcggcagcatggattgctgaaaaaggcggattaaaaaatatccgtgtctttacccgttattggctggcgttgatcggggaatggccttgggaaaagacccctaaccttccccctgaaattatctggttccctgataattttgtcttttcgatttataattttgcccaatgggcgcgggcaaccatggtgccgattgctattctgtccgcgagacgaccaagccgcccgctgcgccctcaagaccgattggatgaactgtttccagaaggccgcgctcgctttgattatgaattgccgaaaaaagaaggcatcgatctttggtcgcaatttttccgaaccactgaccgtggattacattgggttcagtccaatctgttaaagcgcaatagcttgcgtgaagccgctatccgtcatgttttggaatggattatccggcatcaggatgccgatggcggttggggtggaattcagccaccttgggtctatggtttgatggcgttacatggtgaaggctatcagctttatcatccggtgatggccaaggctttgtcggctttggatgatcccggttggcgacatgacagaggcgagtcttcttggatacaggccaccaatagtccggtatgggatacaatgttggccttgatggcgttaaaagacgccaaggccgaggatcgttttacgccggaaatggataaggccgccgattggcttttggctcgacaggtcaaagtcaaaggcgattggtcaatcaaactgcccgatgttgaacccggtggatgggcatttgaatatgccaatgatcgctatcccgataccgatgataccgccgtcgctttgatcgccctttcctcttatcgtgataaggaggagtggcaaaagaaaggcgttgaggacgccattacccgtggggttaattggttgatcgccatgcaaagcgaatgtggcggttggggagcctttgataaggataataacagaagtatcctttccaaaattcctttttgtgatttcggagaatctattgatccgccttcagtcgatgtaacggcgcatgttttagaggcctttggcaccttgggactgtcccgcgatatgccggtcatccaaaaagcgatcgactatgtccgttccgaacaggaagccgaaggcgcgtggtttggtcgttggggcgttaattatatctatggcaccggtgcggttctgcctgctttggcggcgatcggtgaagatatgacccagccttacatcaccaaggcttgcgattggctggtcgcacatcagcaggaagacggcggttggggcgaaagctgctcttcctatatggagattgattccattgggaagggcccaaccacgccgtcccagactgcttgggctttgatggggttgatcgcggccaatcgtcccgaagattatgaagccattgccaagggatgccattatctgattgatcgccaagagcaggatggtagctggaaagaagaagaattcaccggcaccggattccccggttatggcgtgggtcagacgatcaagttggatgatccggctttatcgaaacgattgcttcaaggcgctgaactgtcacgggcgtttatgctgcgttatgatttttatcggcaattcttcccgattatggcgttaagtcgggcagagagactgattgatttgaataattga

SEQ ID NO: 2 - protein, 725 aa, Zymomonas mobilis
MGIDRMNSLSRLLMKKIFGAEKTSYKPASDTIIGTDTLKRPNRRPEPTAKVDKTIFKTMGNSLNNTLVSACDWLIGQQKPDGHWVGAVESNASMEAEWCLALWFLGLEDHPLRPRLGNALLEMQREDGSWGVYFGAGNGDINATVEAYAALRSLGYSADNPVLKKAAAWIAEKGGLKNIRVFTRYWLALIGEWPWEKTPNLPPEIIWFPDNFVFSIYNFAQWARATMVPIAILSARRPSRPLRPQDRLDELFPEGRARFDYELPKKEGIDLWSQFFRTTDRGLHWVQSNLLKRNSLREAAIRHVLEWIIRHQDADGGWGGIQPPWVYGLMALHGEGYQLYHPVMAKALSALDDPGWRHDRGESSWIQATNSPVWDTMLALMALKDAKAEDRFTPEMDKAADWLLARQVKVKGDWSIKLPDVEPGGWAFEYANDRYPDTDDTAVALIALSSYRDKEEWQKKGVEDAITRGVNWLIAMQSECGGWGAFDKDNNRSILSKIPFCDFGESIDPPSVDVTAHVLEAFGTLGLSRDMPVIQKAIDYVRSEQEAEGAWFGRWGVNYIYGTGAVLPALAAIGEDMTQPYITKACDWLVAHQQEDGGWGESCSSYMEIDSIGKGPTTPSQTAWALMGLIAANRPEDYEAIAKGCHYLIDRQEQDGSWKEEEFTGTGFPGYGVGQTIKLDDPALSKRLLQGAELSRAFMLRYDFYRQFFPIMALSRAERLIDLNN

SEQ ID NO: 3 - protein, 680 aa, Streptomyces coelicolor
MTATTDGSTGASLRPLAASASDTDITIPAAAAGVPEAAARATRRATDFLLAKQDAEGWWKGDLETNVTMDAEDLLLRQFLGIQDEETTRAAALFIRGEQREDGTWATFYGGPGELSTTIEAYVALRLAGDSPEAPHMARAAEWIRSRGGIASARVFTRIWLALFGWWKWDDLPELPPELIYFPTWVPLNIYDFGCWARQTIVPLTIVSAKRPVRPAPFPLDELHTDPARPNPPRPLAPVASWDGAFQRIDKALHAYRKVAPRRLRRAAMNSAARWIIERQENDGCWGGIQPPAVYSVIALYLLGYDLEHPVMRAGLESLDRFAVWREDGARMIEACQSPVWDTCLATIALADAGVPEDHPQLVKASDWMLGEQIVRPGDWSVKRPGLPPGGWAFEFHNDNYPDIDDTAEVVLALRRVRHHDPERVEKAIGRGVRWNLGMQSKNGAWGAFDVDNTSAFPNRLPFCDFGEVIDPPSADVTAHVVEMLAVEGLAHDPRTRRGIQWLLDAQETDGSWFGRWGVNYVYGTGSVIPALTAAGLPTSHPAIRRAVRWLESVQNEDGGWGEDLRSYRYVREWSGRGASTASQTGWALMALLAAGERDSKAVERGVAWLAATQREDGSWDEPYFTGTGFPWDFSINYNLYRQVFPLTALGRYVHGEPFAKKPRAADAPAEAAPAEVKGS

SEQ ID NO: 4 - protein, 720 aa, Acetobacter pasteurianus
MNMASRFSLKKILRSGSDTQGTNVNTLIQSGTSDIVRQKPAPQEPADLSALKAMGNSLTHTLSSACEWLMKQQKPDGHWVGSVGSNASMEAEWCLALWFLGLEDHPLRPRLGKALLEMQRPDGSWGTYYGAGSGDINATVESYAALRSLGYAEDDPAVSKAAAWIISKGGLKNVRVFTRYWLALIGEWPWEKTPNLPPEIIWFPDNFVFSIYNFAQWARATMMPLAILSARRPSRPLRPQDRLDALFPGGRANFDYELPTKEGRDVIADFFRLADKGLHWLQSSFLKRAPSREAAIKYVLEWIIWHQDADGGWGGIQPPWVYGLMALHGEGYQFHHPVMAKALDALNDPGWRHDKGDASWIQATNSPVWDTMLSLMALHDANAEERFTPEMDKALDWLLSRQVRVKGDWSVKLPNTEPGGWAFEYANDRYPDTDDTAVALIAIASCRNRPEWQAKGVEEAIGRGVRWLVAMQSSCGGWGAFDKDNNKSILAKIPFCDFGEALDPPSVDVTAHVLEAFGLLGLPRDLPCIQRGLAYIRKEQDPTGPWFGRWGVNYLYGTGAVLPALAALGEDMTQPYISKACDWLINCQQENGGWGESCASYMEVSSIGHGATTPSQTAWALMGLIAANRPQDYEAIAKGCRYLIDLQEEDGSWNEEEFTGTGFPGYGVGQTIKLDDPAISKRLMQGAELSRAFMLRYDLYRQLFPIIALSRASRLIKLGN

SEQ ID NO: 5 - protein, 684 aa, Bradyrhizobium sp.
MTVTSSASARATRDPGNYQTALQSTVRAAADWLIANQKPDGHWVGRAESNACMEAQWCLALWFMGLEDHPLRKRLGQSLLDSQRPDGAWQVYFGAPNGDINATVEAYAALRSLGFRDDEPAVRRAREWIEAKGGLRNIRVFTRYWLALIGEWPWEKTPNIPPEVIWFPLWFPFSIYNFAQWARATLMPIAVLSARRPSRPLPPENRLDALFPHGRKAFDYELPVKAGAGGWDRFFRGADKVLHKLQNLGNRLNLGLFRPAATSRVLEWMIRHQDFDGAWGGIQPPWIYGLMALYAEGYPLNHPVLAKGLDALNDPGWRVDVGDATYIQATNSPVWDTILTLLAFDDAGVLGDYPEAVDKAVDWVLQRQVRVPGDWSMKLPHVKPGGWAFEYANNYYPDTDDTAVALIALAPLRHDPKWKAKGIDEAIQLGVDWLIGMQSQGGGWGAFDKDNNQKILTKIPFCDYGEALDPPSVDVTAHIIEAFGKLGISRNHPSMVQALDYIRREQEPSGPWFGRWGVNYVYGTGAVLPALAAIGEDMTQPYIGRACDWLVAHQQADGGWGESCASYMDVSAVGRGTTTASQTAWALMALLAANRPQDKDAIERGCMWLVERQSAGTWDEPEFTGTGFPGYGVGQTIKLNDPALSQRLMQGPELSRAFMLRYGMYRHYFPLMALGRALRPQSHS

SEQ ID NO: 6 - protein, 658 aa, Zymomonas mobilis
MTVSTSSAFHHSSLSDDVEPIIQKATRALLEKQHQDGHWVFELEADATIPAEYILLKHYLGEPEDLEIEAKIGRYLRRIQGEHGGWSLFYGGDLDLSATVKAYFALKMIGDSPDAPHMLRARNEILARGGAMRANVFTRIQLALFGAMSWEHVPQMPVELMLMPEWFPVHINKMAYWARTVLVPLLVLQALKPVARNRRGILVDELFVPDVLPTLQESGDPIWRRFFSALDKVLHKVEPYWPKNMRAKAIHSCVHFVTERLNGEDGLGAIYPAIANSVMMYDALGYPENHPERAIARRAVEKLMVLDGTEDQGDKEVYCQPCLSPIWDTALVAHAMLEVGGDEAEKSAISALSWLKPQQILDVKGDWAWRRPDLRPGGWAFQYRNDYYPDVDDTAVVTMAMDRAAKLSDLHDDFEESKARAMEWTIGMQSDNGGWGAFDANNSYTYLNNIPFADHGALLDPPTVDVSARCVSMMAQAGISITDPKMKAAVDYLLKEQEEDGSWFGRWGVNYIYGTWSALCALNVAALPHDHLAIQKAVAWLKNIQNEDGGWGENCDSYALDYSGYEPMDSTASQTAWALLGLMAVGEANSEAVTKGINWLAQNQDEEGLWKEDYYSGGGFPRVFYLRYHGYSKYFPLWALARYRNLKKANQPIVHYGM

SEQ ID NO: 7 - protein, 648 aa, Acidithiobacillus caldus
MNPVVHNLTRPHRSAEPRPSALQRSIAAAQAALLQHQAADGHWCFEFEADCTIPAEYILMMHYMDERDAALEAKMAAYLRRKQENHGGWSLYHGGHFDMSASVKAYFALKLAGDDPEAAHMRRARSAILAHGGAERANVFTRITLALFGQVPWRAVPFIPVEILLFPRWFPMHIYKVASWSRTVMVPLFILCSLKPQAKNPLGVHIRELFTRPPEDIDDYFAHALQGWVSRIFLWFDRLGRALESWIPQALRRRAIARAEAWFIERLNGEDGLNGIFPAMVNAHEALALLGYAAEHPYRQQTRAALTKLVVERAGEAYCQPCVSPVWDTCLALHALLEADGDVSEAARRSMQWLLDRQITDAPGDWRERRPHLAGGGWAFQYANPYYPDLDDTAAVAWALARARRPEDRPAVERAANWLAGMQSRNGGFGAYDVDNTYYYLNEIPFADHKALLDPPTADVSGRVLAFLAILDREQDAPVRARLIQYLLREQEPSGAWFGRWGTNYIYGTWSVLMGMAELRDPGAEVRDAMARAAHWLRSVQQDDGGWGESNDSYADPGLAGLGQESTAAQTAWACLALMAAGDSDSESLRRGIQWLQRHQEQPGDWQDPYFNAPGFPRVFYLTYHGYKIYFPLWALARYRNITERHCA

SEQ ID NO: 8 - protein, 643 aa, Acidithiobacillus ferrooxidans
MNRMLQPLHSGAGIFRSSLDRVIAQARQALGGRQAEDGHWCFEFEADCTIPAEYILMQHYMDERDEALEARIAVYLRGKQADHGGWPLYYGGHFDLSASVKVYYALKLAGDDPELPHMRRAREAILAHGGAERSNVFTRITLALFAQVPWRAVPFIPVEIMLLPRWFPFHIYKVASWSRTVMVPLFILCSLKARAKNPLQVHIRELFRRPPDQITDYFSHARRGIVAYIFLSLDRFWRLMEGWIPHGIRRRALKKAEAWFTARINGEDGLNGIFPAMVNAHEALELLGYPPDHDYRRQTGAALRKLVVERANDAYCQPCVSPVWDTCLALHALLEEDGEVSPAVQNGIRWLKNRQIGAEPGDWRESRPHLAGGGWAFQYANPYYPDLDDTAAVGWALARAGRAEDRDSIEKAANWLAGMQSRNGGFGAYDVDNTHYYLNEIPFADHKALLDPPTADVTGRVVAFLAHLARPRDRDVLRRAVAYLLREQESSGAWFGRWGTNYIYGTWSVLMALAELNDPSLKPTMERAAYWLRAVQQGDGGWGESNDSYSDPGLAGMGQTSTAAQTAWACLGLMAAGDRDSVALHRGIAWLQAHQEGDGCWQAPFFNAPGFPKVFYLIYHGYAFYFPLWALARYRNLGCMAHE

SEQ ID NO: 9 - protein, 679 aa, Acidobacterium capsulatum
MSVSERAQPGGNPIPGSTSQSAVKFGRIDAALEDVKRAIAGAKDRVFAQQSKDGWWCGELEADSMLEADYIFAHTLLGTGDAGKMKRALTEMLRYQNEDGSWSIYPGGPGNISLTVKCYFSAKLMGMTADNPILVKAREWILAHGGVVECNTFTKIYLCFLGQYEYDAVPAIPPEIVLFPNWFYFNIYEISSWSRAILVPLSIAYAKKPFKKIPPEQGIDELFVGGREKANLHLRWDSKNLLSWRNFFLALDRVTHWFERVHIRPLRSIALKKAEKWMLARFEMSDGLGAIYPAMLNAIIALRCLGYSLDDPQVLRAMDEFEKLGIDEPEGTAEYAEPTFRMQPCVSPVWDTAQAVFALGEAGVPRNDPRMQKAADWLLSKEVRHKGDWAMKVRNAQPGGWYFEFNNEFYPDVDDSAQVLLALNKVDNPRERYQYDVCQRAIDWIFAMQCRNGGWASFDKDNTKMIFQYVPFADHNAMLDPPTVDITGRILEMLATYGYTRKDRRVEKAIKFIYDEQEPDGSWFGRWGVNYLYGTFLVLRGLEAIGVWNHEPQIQQAAEWIRSVQNADGGWGETCGSYDDPNTRGVGPSTPSQTAWAILGLLSAGDDRSDSVAKGIKWLLAHQKPDGGWDESTGSGSKHQALYTGTGFPRVFYLAYHQYRDYFPLLALTNYEKAMERGE

SEQ ID NO: 10 - protein, 633 aa, Acidothermus cellulolyticus
MTQASVREDAKAALDRAVDYLLSLQDEKGFWKGELETNVTIEAEDLLLREFLGIRTPDITAETARWIRAKQRSDGTWATFYDGPPDLSTSVEAYVALKLAGDDPAAPHMEKAAAYIRGAGGVERTRVFTRLWLALFGLWPWDDLPTLPPEMIFLPSWFPLNIYDWGCWARQTVVPLTIVSALRPVRPIPLSIDEIRTGAPPPPRDPAWTIRGFFQRLDDLLRGYRRVADHGPARLFRRLAMRRAAEWIIARQEADGSWGGIQPPWVYSLIALHLLGYPLDHPVLRRGLDGLNGFTIREETADGAVRRLEACQSPVWDTALAVTALRDAGLPADHPRVQAAARWLVGEEVRVAGDWAVRRPGLPPGGWAFEFANDNYPDTDDTAEVVLALRRVRLEDADQQALEAAVRRATTWVIGMQSTDGGWGAFDADNTRELVLRLPFCDFGAVIDPPSADVTAHIVEMLAALGMRDHPATVAGVRWLLAHQEPDGSWFGRWGANHIYGTGAVVPALIAAGVSPDTPPIRRAIRWLEEHQNPDGGWGEDLRSYTDPALWVGRGVSTASQTAWALLALLAAGEEASPAVDRGVRWLVTTQQPDGGWDEPHYTGTGFPGDFYINYHLYRLVFPISALGRYVNR

SEQ ID NO: 11 - protein, 695 aa, Adiantum capillus-veneris
MLPYNQDHHFGKVAENATMPPTLDEAIERSQDFLLSLQYPEGYWWAELEANVTLTAQTIMLYKILGIDHKYPIHKMKTYILRTQRAHGGWEIFYGDGGCLSTTIGAYMALRILGVPKTDPVLQKALKLIHSKGGVTKSRMFTKICLALLGCYDWKGIPSLPPWLVLLPSWFPFSLYDTASWVRGCVVPLTIIFDKKPVYKLNPLLCLDELYSEGKGKARVHLSFIPGDWTSNFFVGLDHVFKYMENLGVVPFRQWGIKEAERWTLERHEDSGDFHGIYPPMFYSIVSYSLLGYEITDPVVHRALESMRGFTVEREDECVVQSCISPMWDTAFVIRSLAESGLQPDHPALQKAGEWLLQKQATQHGNWFYKKRTGRAGGWAFQFFNRWYPDVDDSAAVSMALNAIKLQDDDVKKGAIKRCAEWISVMQCKDGGWAAYDCDNDREWLNCTPFGDLKAMIDPNTVDVTARVLEMVGRVKEAGDASAILPPRAIARGLAYLRREQETEGCWYGRWGVNYIYGTSGALMALALVAPSTHKEEIERGARWLVEVQNKRGTKGANGYSHTNGAREGGVAMNGNCKNMGAPEDGGWGETCFSYNDITLKGRNEVSTVSQTAWALQGLLAAGDALGKYEVESIEHGVQYLLSTQRKDGSWCEKHFTGGGFPRFFYIRYHLYAGHFPLSALARYRDRVRAGKMAK

SEQ ID NO: 12 - protein, 740 aa, Ajellomyces capsulatus
MMYNNQWYFNQFNDIFCFPEQQKEYFPPTGTNISLNLKKRPDRQLLAHGASDLNGPFHLSQHNAFSAMLLAEVQKVLRLAVGHSLDLQRTDGAWCGEVHSNATFTAQYVFLQQQLGLPLDPTEIEGLSRWLFSQQNEDGSWGLGPGLGGDVSTTTETYLALKILGVSPEDPRMAAARSSIIKAGSLPATRMFTRVFLASFGLIPWSAVPPLPAELILLPTLFPVNIYNLSSWARATCVPLLLIRHHEPLHSLPNGRHAENDFLDELWTKDIPRDFCYTTPLSRMWRLGDYAGIFFTSADHGLRFLGQYFNSPLRNLSRRKIINWILDHQEQSGEWAGYWPPQHNNIWALSLEGYSLDHPVLRRGIAAVKSFVLHDVTGMRAQVTVSQVWDTALMSIALSDSAPSTGIISPTQAIDWLMHHEVASHRGDWRVLRPKLATGGFCFEEFNTLYPDVDDTAAVIMALIKSNPAHLISGCVRRAAQWILGMQNRDGGWGAFDWNNDKFFLNKIPFSDMDSLCDPSTPDVTGRIIECFGMMMAGRHGYSLDGPLESRLRASSQLAIAYLLGCQENNGSWWGRWGVNYLYGTSNVLCGLAYYYDRSGLSKGDGKSNSHIVSAVDRASEWLKARQHSNGGWGEGPESYDSAQLAGCGQPTASQSAWVTMALLNYLSPTDEVIQRGISYLVRSQVKYGDESRATWPLERYTATGFPGHLYMEYDYYRHYFPIMALGRYVNKLSESHKLL

SEQ ID NO: 13 - protein, 648 aa, Ajellomyces capsulatus
MAQMASSLGSPRLLLRMGREAAQQQHLASGTEVQKALRLAVGHSLDLQRTDGAWCGEVHSNATFTAQYVFLQQQIGLPLDPTEIEGLSRWLFSQQNEDGSWGLGPGLGGDVSTTTETYLALKILGVSPEDPRMAAARTSIIKAGSLPATRMFTRVFLASFGLIPWSAVPPLPAELILLPTLFPVNIYNLSSWARATCVPLLLIRHHEPLHSLPNGRHAENDFLDELWTKDIPRDFCYTTPLSRMWRLGDYAGIFFTSADHGFRFLGQYFNSPLRNLSRRKIINWILDHQEQSGEWAGYWPPQHNNIWALSLEGYSLDHPVLRRGIAAVKSFVLHDATGMRAQVTVSQVWDTALMSIALSDSAPSTGIISPTQAIDWLMHHEVASHRGDWRVLRPKLATGGFCFEEFNTLYPDVDDTAAVIMALIKSNPAHLISGCVRQCFGMMMAGRHGYSLDCQLETRLRASSQLAIAYLLGCQENNGSWWGRWGVNYLYGTSNVLCGLAYYYDRSSLSKGDGKSNSNIVSAVDRASEWLKARQHSNGGWGEGLESYDNAQLAGCGQPTASQSAWVTMALLNYLSPTDEVIQRGVSYLVRNQVKYGDESRATWPLERYTATGFPGHLYMEYDYYRHYFPIMALGRYVNKLSGSHKLL

SEQ ID NO: 14 - protein, 673 aa, Ajellomyces capsulatus
MLLAEVQKALRLAVGHSLDLQRADGAWCGEVHSNATFTSQYVFLQQQIGLPLDPTEIEGLSRWLFSQQNEDGSWGLGPGLGGDVSTTTETYLALKILGVSPEDPRMAAARTSIIKAGSLPATRMFTRVFLASFGLIPWSAVPPLPAELILLPTLFPVNIYNLSSWARATCVPLLLIRHHEPLHSLPNGRHAENDFLDELWTKDIPRDFCYTTPLSRMWRLGDYAGIFFTSADHGLRFLGQYFHSPLRNLSRRKIINWILDHQEQSGEWAGYWPPQHNNIWALSLEGYSLDHPVLRRGIAAVKSFVLHDATGMRAQVTVSQVWDTALMSIALSDSAPSTGIISPTQAIDWLMHHEVASHRGDWRVLRPKLATGGFCFEEFNTLYPDVDDTAAVIMALIKSNPAHLISGCVRRAAQWILGMQNRDGGWGAFDWNNDKFFLNKIPFSDMDSLCDPSTPDVTGRIIECFGMMMAGRHGYSLDCQLENRLRASSQLAIAYLLGCQENNGSWWGRWGVNYLYGTSNVLCGLAYYYDRSSLSKGDVKSNSNIVSAVDRASEWLKARQHSNGGWGEGPESYDNAQLAGCGQPTASQSAWVTMALLNYLSPTDEVIQRGVSYLVRNQVKYGDESRATWLLERYTATGFPGHLYMEYDYYRHYFPIMALGRYVNKLSGSHKLL

SEQ ID NO: 15 - protein, 631 aa, Alicyclobacillus acidocaldarius
MAEQLVEAPAYARTLDRAVEYLLSCQKDEGYWWGPLLSNVTMEAEYVLLCHILDRVDRDRMEKIRRYLLHEQREDGTWALYPGGPPDLDTTIEAYVALKYIGMSRDEEPMQKALRFIQSQGGIESSRVFTRMWLALVGEYPWEKVPMVPPEIMFLGKRMPLNIYEFGSWARATVVAISIVMSRQPVFPLPERARVPELYDTDVPPRRRGAKGGGGRIFDALDRALHGYQKLSVHPFRRAAEIRALDWLLERQAGDGSWGGIQPPWFYTLIALKILDMTQHPAFIKGWEGLELYGVDLDYGGWMFQASISPVWDTGLAVLALRAAGLPADHDRLVKAGEWLLDRQITVPGDWAVKRPNLKPGGFAFQFDNVYYPDVDDTAVVVWALNSLRLPDERRRRDVMTKGFRWIVGMQSSNGGWGAYDVDNTSDLPNHIPFCDFGEVTDPPSEDVTAHVLECFGSFGYDDAWKVIRRAVEYLKREQRPDGSWFGRWGVNYLYGTGAVVPALKAVGIDVREPFIQKALDWVEQHQNPDGGWGEDCRSYEDPAYAGKGASTPSQTAWALMALIAGGRAESDSVRRGVQYLVETQRPDGGWDEPYYTGTGFPGDFYLGYTMYRHVFPTLALGRYKQAIERR

SEQ ID NO: 16 - protein, 631 aa, Alicyclobacillus acidocaldarius [sequence omitted]

SEQ ID NO: 17 - protein, 227 aa, Alicyclobacillus acidocaldarius
QASISPVWDTGLAVLALRAAGLPADHDRLVKAGEWLLDRQITVPGDWVVKRPNLNPGGFALQFDNVYYPDVDDTAVVIWALNTLRLPDERRRRDAMTKGFRWIVGMQSSNGGWGAYDVDNTSDLPNHIPFCDFGEVTDPPSEDVTAHVLECFGSFGYDDAWKVIQRAVAYLKREQKPDGSWFGRWGVNYIYGTGAVVSALKAVGIDMREPYIQKALDWVEQHQNPDG

SEQ ID NO: 18 - protein, 634 aa, Alicyclobacillus acidoterrestris
MTKQLLDTPMVQATLEAGVAHLLRRQAPDGYWWAPLLSNVCMEAEYVLLCHCLGKKNPEREAQIRKYIISQRREDGTWSIYPGGPSDLNATVEAYVALKYLGEPASDPQMVQAKEFIQNEGGIESTRVFTRLWLAMVGQYPWDKLPVIPPEIMHLPKSVPLNIYDFASWARATIVTLSYRHESPTCDATSGLCKGSGIVRGEGPPKRRSAKGGDSGFFVALDKFLKAYNKWPIQPGRKSGEQKALEWILAHQEADGCWGGIQPPWFYALLALKCLNMTDHPAFVKGFEGLEAYGVHTSDGGWMFQASISPIWDTGLTVLALRSAGLPPDHPALIKAGEWLVSKQILKDGDWKVRRRKAKPGGWAFEFHCENYPDVDDTAMVVLALNGIQLPDEGKRRDALTRGFRWLREMQSSNGGWGAYDVDNTRQLTKSDSIFATSGEVIDPPSEDVTAHVLECFGSFGYDEAWKVIRKAVEYLKAQQRPDGSWFGRWGVNYVYGIGAVVPGLKAVGVDMREPWVQKSLDWLVEHQNEDGGWGEDCRSYDDPRLAGQGVSTPSQTAWALMALIAGGRVESDAVLRGVTYLHDTQRADGGWDEEVYTGTGFPGDFYLAYTMYRDILPVWALGRYQEAMQRIRG

SEQ ID NO: 19 - protein, 236 aa, Alicyclobacillus acidoterrestris
GGWMFQASISPIWDTGLTVLALRSAGLPPDHPALIKAGEWLVSKQILKDGDWKVRRRKAKPGGWAFEFHCENYPDVDDTAMVVLALNGIQLPDEGKRRDALTRGFRWLREMQSSNGGWGAYDVDNTRQLTNRIPFCNFGEVIDPPSEDVTAHVLECFGSFGYDEAWKVIRKAVEYLKAQQRPDGSWFGRWGVNYVYGIGAVVPGLKAVGVDMREPWVQKSLDWLVEHQNEDGGWGE

SEQ ID NO: 20 - protein, 637 aa, Anabaena variabilis
MRTQDRVQVNSIAEAIAASQKYLLSLQNPTGYWWAELESNVTITAEVVLLHKIWGTDKTRPLHKIEAYLRSQQKQHGGWELFYGDGGELSTSVEAYMALKLLGVPATDPAMIQARDFILQRGGISKTRIFTKFHLALIGCYNWRGLPSLPAWVMLLPNQFPVNIYEMSSWARSSTVPLLIVFDQKPVYQVNPAITLDELYAEGVENVRYELPRSGDWTDLFLTLDEGFKLAESFNFIPFREEGIKAAEKWIIERQEATGDWGGIIPAMLNSMLALRVLGYATNDPIVERGLQAIDNFAIETADCYRVQPCVSPVWDTAWVIRALIDSGMAPDHPAIVKAGEWLLQKQIFDYGDWNVKNRQGQPGAWAFEFDNRFYPDVDDTAVVVMALHAAKLPHEQLKQKACDRALQWVASMQCKPGGWAAFDIDNDQDWLNAVPYGDLKAMIDPNTADVTARVIEMLGACNLSIDSHDLERALTYLLNEQEAEGCWFGRWGVNYIYGTSGVLCALALINPQKYQRHIQQGATWLVGCQNPDGGWGETCFSYNDPSLKGQGDSTPSQTAWALIGLIAAGEATGNFAHDVIERGINHLVSTQQPDGSWFEAYFTGTGFPCHFYLKYHYYQQYFPLIALGRYQAINPL

SEQ ID NO: 21 - protein, 654 aa, Anaeromyxobacter sp.
MSGEVRVAGDALAEDAGRAAAAASQYLYRTQQRDHWRAELESNVTVTAEYVLLRQALGLDLEERRDALVRYLCSRQKADGSFGIASTLPGDVSTTAEAYLALRLLGLDREDERLRAAERFIRGAGGLARVRVFTRINLALFGLFPWEAVPTVPAELIFLPRWAPVNVYRLASWARSTMVPLFVLFHHRPVFALPGGAGSDWLDHLWLGPGDKRVPYRTSVMETVRRHGPGWKAFFNAADAWLRVHDRLRHLPPLGRLRTEALRACEEWILARQEASGDWAGIFPPMLNGVLALHVAGHGLDAAPVRRGLEAIERFAVSDREGFRIEACQSPVWDTILALIGLLDSGESPTDPRLVAARRWIEGMQLTNDWGDWKVYDPRGEPGGWAFEYANSWYPDVDDTAAVIVGLLKHDPASRAGETVRRAAAWVASMQNRDGGWAAFDVNNDRLFLNEIPFSDMDSLCDPSSPDVTGRVLEAFGMLDAPHLRAACRRGVAYLRRAQEPEGSWYGRWGVNYVYGTSNVLNGLARQRVPASDPMVARALGWLDSVQNADGGFGEGLESYADRAAMGRGPSTASQTAWGVMGLLAYRAADDAAVRRGIAWLVERQLADGEAQGSWEEEAFTGTGFPRHFYLRYHLYRHYFPLMALGRFCAQGRG

SEQ ID NO: 22 - protein, 710 aa, Aspergillus clavatus
MATLTTMATTATMATTEASQPLEAQARTALTKATSYAWEIISNRHWCGELESNVTVTCEHIFFLYVLYQHIDPDEGSQYRQWLLSQQNADGSWGIAPNYPGDVSTSAEAYLALRIIGMSPDSPELFQARTFIRAAGGLSKMRMFTRIFFAEFGLVPWTAIPQLPAEFILVPAHFPISIYRLASWARSNVVPLLIIAHHRPLYPLPNGLHKQNPFLDELWLDPATKPLPYGSLDPTDPLSFVFTILDKALSYLGGLRRCPTRGYARRRCIQWILQHQEKAGDWAGIIPPMHAGIKALWLEGYKLHDEPIQLGLAAIERFTWTDNRGKRLQCCISPVWDTVLMIRALQDTPASLGIKSDPRIADALAWTAENQHRGPEGDWRVYQPNIPVGGWAFEYSNTWYPDIDDTAAAVLAFLTHDPATARSRLVRDAVLWIVGMQNADGGWAAFDHENNRLFLNKIPFSDMESLCDPSTPDVTGRTIECLGMLRDLLMLPAEKAGKKGEKYGYPDGERDAAADSHLLKIINTACARAIPYLIRTQEATGAWYGRWAVNYVYGTCLVLCGLQYFKHDPTFAPEIDTMATRAVKWLRQIQNSDGGWGESVLSYREPWRAGCGPSTPSQTAWALMGLLTVCGGEDRSVQRGVRHLVDTQDDILSKGEGGAAAWTEREFTSTGFPNHFYISYTLYRVYFPITALGRYLSLVEGGKKENGGGA

SEQ ID NO: 23 - protein, 673 aa, Aspergillus flavus
MTTGHRQFDDGLSERERLIHEAGLTLQRSMDYAYNVVRSDGHWCGEMSSNVTITAEYIFLRQALGLDLKTDGAAYCRHILSQQNSDGSWGLAPEYPGDVSTTTEAYLALKMLGLSTDAPAMQQAKAFVLNAGGVAKVRVFTRIFLATFGLFPWKAVPQLPVELILLPSACPINIYKFASWARGTIAPLLIICHHQPVYALPNGVFAENEYLDELWQDPTNKSEPYSPSIWELLSQGDITGLTFSLLDKLLYQLNGLRSIPLLRSYALKQCMKWILERQEPTGDWAGIFPPMHASVYAFVLEGYKLEDPPVRLGIEALENFAWEDAKGKRVQPCVSPVWDTTLMSIALSDAATPNHQIVDRAIQWIRDRQLLEPRGDWRVYRPRLAPGGFSFEYTNSHYPDIDDSAAIILAQVKHDPISANSSSVIAAATWILGMQNPDGGWAAFDVENDKLFLNKIPFSDMDSLCDTSCADITGRILEAFGLLIRRVPDKDSSQLFQLLPAIRAACRRGIRYLASTQEANGAWFGRWGCNYIYGTSHALCGLAYFLQEDQQVPAMVQPALQWLKSQQNDDGGWGESLLSYQSPERKEQRSTASQTAWALMGLLAHLPHTDIVIERGIRWLVSSQRPVETLGSTWPEPVYTGTGFPNHFYLGYDYYRHYFPMMALGRYLRGVQG

SEQ ID NO: 24 - protein, 738 aa, Aspergillus fumigatus
MLGAIREPPIDVQIALHSRDDNQTGLVLRGTRRTVDRVLKGLCSSPCFFCSVSLTMATLTTTMATTATMATTEASKPLEAQARTALTKATNYAWEIFSNRHWCGELESNVTVTCEHIFFLYVLYQHIDPGEGSQYRQWLLSQQNSDGSWGIAPNYPGDISTSAEAYLALRIIGMSTDSPELYRARTFIRAAGGLSKMRMFTRIFFAEFGLVPWTAIPQLPAEFILVPAHFPISIYRLASWARSNVVPLLIIAHHRPLYPLPNGLHKQNPFLDELWLDPATKPLPYGSSDPTDPVAFVFTILDKALSYLGGLRRSPTRGYARRRCVQWILQHQEKAGDWAGIIPPMHAGIKALLLEGYKLHDEPIQLGLAAIERFTWADNRGKRLQCCISPVWDTVLMIRALQDTPASLGIKLDPRIADALAWTAENQHRGPEGDWRVYKPNIPVGGWAFEYHNTWYPDIDDTAAAVLAFLTHDPATARSRLVRDAVLWIVGMQNADGGWAAFDHENNQLFLNKIPFSDMESLCDPSTPDVTGRTIECLGMLRDLLMRPAENAENGEKYGYPDGEGDAAADAHLLQIINTACARAIPYLIRSQEATGTWYGRWAVNYVYGTCLVLCGLQYFKHDPKFAPEIQAMAARAVKWLKQVQNSDGGWGESLLSYREPWRAGCGPSTPSQTAWALMGILTVCGGEDRSVQRGVRHLVDTQDDTLSQGDGGAAAWTEREFTIREPLHEASQRIGSD

SEQ ID NO: 25 - protein, 689 aa, Aspergillus fumigatus
MLQTEAITTEGLRVRSLSPDDPLLPRIKQAIKLSGQHSRGEMHSDGHWCGEVKTNATTSAEHVLLCQALGINLDADREAFISWFRCTQGADGGWSTAPDQAGDISVTVEAYLALKILGLSEDDAAMRRARDFAIAAGGVAKVRIFTRIYLALFGLFPWAAVPELPPELILLPSRVPVSIYHWSAWARATVVPLLIISHHRPIYALPGGGKGTSSDYLDELWCDPQNKMIPYNHDEPTAWRSDPFASIFTLADSILHRLDGLRSFNPFRRFALQKCVDWILEHQEDMGDIGDIMPPLHGAMLALRLEGYPLHSGPIHRGLEAIERFAYRDKQGKRIQTTVSAFWDTSLMLIALGDAGMASKPWLTRSLGWLQQHQRLGNYGDWKVNNHGLKAGGFSFGYFNTWYPDVDDTASAVLAMIRQDERLVHSASVLDALNWLLGMQNTDGGWGAFDRDNDKHFLNKIPFSDMDALCDPSTPDVTGHVLEAFGLFLALSKADALADRVVAASRRAIRYLSDTHVLSRGWYGRWGCNYIYGTSAVLCALAYFGSENDALSGVRVMKDAINQAIRWLETVQNPDGGWGETVDSYKDPSRAGSGPSTASQTAWAIMALLPYLPPSTEVIQRGMEYLLRTQTKTASQGATWHEKAYTATGFPKYFYMGYSLYAHYFPMMALGRYAYPCPAWHENWRLKRD

SEQ ID NO: 26 - protein, 671 aa, Aspergillus fumigatus
MATLTTTMATTATMATTEASKPLEAQARTALTKATNYAWEIFSNRHWCGELESNVTVTCEHIFFLYVLYQHIDPGEGSQYRQWLLLQQNSDGSWGIAPNYPGDISTSAEAYLALRIIGMSTDSPELYRARTFIRAAGGLSKMRMFTRIFFAEFGLVPWTAIPQLPAEFILVPAHFPISIYRLASWARSNVVPLLIIAHHRPLYPLPNGLHKQNPFLDELWLDPATKPLPYGSSDPTDPVAFVFTILDKALSYLGGLRRSPTRGYARRRCVQWILQHQEKAGDWAGIIPPMHAGIKALLLEGYKLHDEPIQLGLAAIERFTWADNRGKRLQCCISPVWDTRVYKPNIPVGGWAFEYHNTWYPDIDDTAAAVLAFLTHDPATARSRLVRDAVLWIVGMQNADGGWAAFDHENNQLFLNKIPFSDMESLCDPSTPDVTGRTIECLGMLRDLLMRPAENAENGEKYGYPDGEGDAAADAHLLQIINTACARAIPYLIRSQEATGTWYGRWAVNYVYGTCLVLCGLQYFKHDPKFAPEIQAMAARAVKWLKQVQNSDGGWGESLLSYREPWRAGCGPSTPSQTAWALMGILTVCGGEDRSVQRGVRHLVDTQDDTLSQGDGGAAAWTEREFTSTGFPNHFYISYTLYRVYFPITALGRYLSLIEGGQEKKKKGGGT

SEQ ID NO: 27 - protein, 693 aa, Aspergillus niger
MAHQETMASETSISLHTLACDATKLAGTYALRQVREDGHWYGEMKSNATITAEYVFLAQALGFSIEEDRDDLIKYFLSEQNTDGSWSLAYDFPGDVSVTAEAYFALCLLGLDRSHPAMASAREFTLSKGGIAKVRVFTRMFFACFGLFPWSAVPELPAELILLPAAAPMSIYQLASWARATVVPMLVIRHHRPIYALPNGRSSSNEYLDELWVDPTDKMVPYSPSLWSLWNDDLTAFGFTLADNILKALGGLRWFPSRKIALRHCVAWILERQEPEGDIGGIFPPLHAALFALALEGYGLESSPVRRGIDALQNTYAWRDSTGLRIQGCISPILDTILMTIGLIDSSLPAESPLVARSSRYLKAHQQLGNEGDWRVYNGNVPSGGFNFEYFNSWYPDIDDTAAAILAMVKQDPNLLDLGPILSAVQWILGLQNDDGGWAAFDRENNYLFLNKIPFSDMDSFCDPSTADVTGRVIECFGLNGKNPIPRFFIDDMSSATERAIDFLSTEQEADGSWYGRWGSNYIYGTSAVLCGLVYHLEGWDDTYPVMEKRHKVDTHAALDWLKRHQNPDGGWGERLESYYEPRLAGNGPSTASQTAWALMGLLAYLAPTDESITRGIQYLSRTQIKEGELAGSWKEDHYTGTGFPNHFYLCYTLYSQYFPMMALGRYTSLSGYRPLENLESTVEDHKGNSSDC

SEQ ID NO: 28 - protein, 653 aa, Aspergillus niger
MMTLREEGHKEGITPGKEQLTSDIEHSLKLATEYALSSIRSDGHWCGELRSNVTITAEYIFLRHALGLDLRTDNAAYCRYILSQQNCDGSWGLAPEYPGDVSTTTEAYLALKLLGTSPDMPAMQQARAFVRKAGGAEKVRVFTRIFLATFGLFPWDAVPQLPVELILLPSSCPINMYTLASWARGTIAPLLIICHHQPVYALPEDYLDELWLDPTDKNVPYGSSLRDLLSRGDITGLAFSVVDNLLYYLNGLRSVPLLRSYARRKCIQWILERQEPTGDWAGIFPPMHASIYAFVLEGYELNDPPVRLGIQALENFAWEDEKGKRIQACVSPVWDTALMSIGLCDAMSPDKQILQQAITWIRNRQLLKPCGDWRIYRSKLAPGGFSFEYENSHYPDVDDTAAIILAQLKQDPQSVASDSVIAAATWILGMQNPDGGWAAFDVENDKLFLNKIPFSDMDSLCDTSCADITGRILEAFGLMMKRELKRPVLSPMLRHACIRGITYLASTQESNGAWFGRWGCNYIYGTCHALGLVAPALQWLKSKQNDDGGWGEPLLSYRTPGTQLQQQSTPSQTAWALMGLLAHLPLTDPAIERGIRWLVCSQQPEKGNGASWPEAVYTGTGFPNHFYLGYDYYRHYFPMMALGRYLQASQAQA

SEQ ID NO: 29 - protein, 673 aa, Aspergillus oryzae
MTTGHRQFDDGLSERERLIHEAGLTLQRSMDYAYNVVRSDGHWCGEMSSNVTITAEYIFLRQALGLDLKTDGAAYCRHILSQQNSDGSWGLAPEYPGDVSTTTEAYLALKMLGLSTDAPAMQQAKAFVLNAGGVAKVRVFTRIFLATFGLFPWKAVPQLPVELILLPSACPINIYKFASWARGTIAPLLIICHHQPVYALPNGVFAENEYLDELWQDSTNKSEPYSPSIWELLSQGDITGLTFSLLDKLLYQLNGLRSIPLLRSYALKQCMKWILERQEPTGDWAGIFPPMHASVYAFVLEGYKLEDPPVRLGIEALENFAWEDAKGKRVQPCVSPVWDTTLMSIALSDAATPNHQIVDRAIQWIRDRQLLEPRGDWRVYRPRLAPGGFSFEYTNSHYPDIDDSAAIILAQVKHDPISANSSSVIAAATWILGMQNPDGGWAAFDVENDKLFLNKIPFSDMDSLCDTSCADITGRILEAFGLLIRRVPDKDSSQLFQLLPAIRAACRRGIRYLASTQEANGAWFGRWGCNYIYGTSHALCGLAYFLQEDQQVPAMVQPALQWLKSQQNDDGGWGESLLSYQSPERKEQRSTASQTAWALMGLLAHLPHTDIVIERGIRWLVSSQRPVETLGSTWPEPVYTGTGFPNHFYLGYDYYRHYFPMMALGRYLRGVQG

SEQ ID NO: 30 - protein, 659 aa, Azotobacter vinelandii
MERSSLLVPASIDSHSRESETTGLDQAIVRARAALLGRQGADGHWCFELESDCTITAEYILMMHFTDEIDEDLQERMARYLRATQVQETHGGWPQYVGGAIDLSCTVKAYYALKAAGDSPEAPHMRRAREAVLALGGAAKSNVFTRILLAMFEQVPWRAVPYLPVEIMLLPRWAPIHIEKMSYWARTTLVPLTILCSLKARAANPKRVDIRELFVTAPEQERHYFLRGGLLNRIFLGLDKFARTLDRWMPKSLRQHAIRKAEAWFLPRMNGEDGLGAIFPPMVNCYEAMILLGYPKDHPARKTCLRSIQKLIVHRDDGSAYCQPCVSPVWDTAWSAMALIHSGDDTATQTAIARAGDWLVQRQELDCRGDWEAQAPQAAPGGWAFQYANGYYPDIDDTALVAALLHISDRRRGQPGQHAFNIDRAVDWMLALQSRNGGFAAFDADNTHYYLNAIPFADHGALLDPPTEDVSGRVAACLGILKRDQDRDGLRRCIDYLRTTQQPDGSWWGRWGSNYIYGTWSALSGLALAGEDLRQPYLRKSVDWLRTRQHPDGGWGETNDSYIDPHLAGTNAGISTPHSTAWAVLAQLAMGEVESDSVRRGIAFLLACQQTDGLWSHPSHNAPGFPRVYYLKYHGYAAYFPLYALARYRHLLNRSREQR

SEQ ID NO: 31 - protein, 627 aa, Bacillus amyloliquefaciens
MSTIHENVRSRQKKTISLLRETQNADGSWSFCFEGPILTNAFLILLLTSLGDNDKELIAELAEGIRAKQRPDGTFANYPDDRKGNVTATVQGYAGLLASGLYSRSEAHMIQAERFIISNGGLRNVHFMTKWMLAANGLYPWPALHLPLSFLVIPPTFPLHFYQFSTYARIHFVPMAVTLNKRFSLKNPNVSSLAHLDRHMTKNPFTWLRSDQDENRDLSSLFAHWKRLLQIPAAFHQLGLRTAKTYMLDRIEEDGTLYSYASATIFMVYGLLALGVSRHSPVLRKALAGTKALLTSCGNIPYLENSTSTVWDTALLNYALMKSGISDNDQMITSAARFLRERQQKKVADWAVHNPHAEPGGWGFSNINTNNPDCDDTAAVLKAIPRKLYPASWERGLSWLLSMQNSDGGFSAFEKNVNHPLVRLLPLESAEEAAIDPSTSDLTGRVLHCLGEAGLSSDHPQIEKAVQWLIRHQEEDGSWYGRWGVCYIYGTWAALTGMKACGVSQNHPAVKKAIRWLKSIQNEDGSWGESCKSAEEKTYVPLSYGTLVQTAWAAEALLQYEKTHHQAVTKGISFLIENRHYEGAAFSYPTGIGLPKQFYIRYHSYPYVFSLLALSTFMKMSEKEEEK

SEQ ID NO: 32 - protein, 617 aa, Bacillus anthracis
MLLYEKAHEEIVRRATALQTMQWQDGTWRFCFEGAPLTDCHMIFLLKLLGRDKEIEPFVERVASLQTNEGTWKLHEDEVGGNLSATIQSYAALLASKKYTKEDANMKRAENFIQERGGVARAHFMTKFLLAIHGEYEYPSLFHLPTPIMFLQNDSPFSIFELSSSARIHLIPMMLCLNKRFRVGKKLLPNLNHIAGGGGEWFREDRSPVFQTLLSDVKQIISYPLSLHHKGYEEIERFMKERIDENGTLYSYATASFYMIYALLALGHSLQSSMIQKAIAGITSYIWKMERGNHLQNSPSTVWDTALLSYALQEAQVSKDNKMIQNATAYLLKKQHTKKADWSVHAPALTPGGWGFSDVNTTIPDIDDTTAVLRALARSRGNKNIDNAWKKGGNWIKGLQNNDGGWGAFEKGVTSKLLAKLPIENASDMITDPSTPDITGRVLEFFGTYAQNELPEKQIQRAINWLMNVQEENGSWYGKWGICYLYGTWAVMTGLRSLGIPSSNPSLTRAASWLEHIQHEDGGWGESCHSSVEKRFVTLPFSTPSQTAWALDALISYYDTETPAIRKGVSYLLSNPYVNERYPTGTGLPGAFYIRYHSYAHIYPLLTLAHYIKKYRK

SEQ ID NO: 33 - protein, 631 aa, Bacillus cereus
MNIVIRISKGWVSNLLLYEKVHEEIARRTTALQTMQRQDGTWQFCFEGAPLTDCHMIFLLKLLGRDKEIEPFVKRLASLQTNEGTWKLYEDEVGGNLSATIQSYAALLASKKYTKEDANMKRAEMFINERGGVARAHFMTKFLLAIHGEYEYPSLFHLPTPIMFLQNDSPLSIFELSSSARIHLIPMMVCLNKRFQVGKKLLPNLNHIAGGGGEWFREDRSPMFQTLLSDVKQIISYPLSLHHKGYEEVERFMKERIDENGTLYSYATASFYMIYALLALGHSLQSSMIQKAIAGITSYIWKMEKGNHLQNSPSTVWDTALLSYTLQEAHASKDNKMIQHAAAYVLKKQHTKKADWSVHAPGLIPGGWGFSDVNTTIPDVDDTTAVLRALARSRGNENVDNAWKKGVNWVKGLQNNDGGWGAFEKGVTSNLLANLPIENASDMITDPSTPDITGRVLELFGTYAQNELPEKQKQSAINWLMNVQEENGSWYGKWGICYIYGTWAVMTGLRSLGIPSSNPSMKRAALWLEHIQHEDGGWGESCQSSVEKRFITLPFSTPSQTAWALDALISYHDEETPAIRKGISYLLANPYVNEKYPTGTGLPGGFYIHYHSYAYIYPLLTLAHYIKKYRK

SEQ ID NO: 34 - protein, 631 aa, Bacillus cereus
MNIVIRISKGWVSNLLLYEKVHEEIARRTTALQSMQRQDGTWRFCFEGAPLTDCHMIFLLKLLGRDKEIEPFVKRLASLQTNEGTWKLYEDEVGGNLSATIQSYAALLASEKYTKEDANMKRAEMFINERGGVARAHFMTKFLLAIHGEYEYPSLFHLPTPIMFLQNDSPLSIFELSSSARIHLIPMMLCLNKRFRVGKKLLPNLNHIAGGGGEWFREDRSPVFQTLVSDVKKIITYPLSLHHKGYEEVERFMKERIDENGTLYSYATASFYMIYALLALGHSLQSSMIQKAIAGITSYMWKMESGNHVQNSPSTVWDTALLSYALQEAHVLKDNKMLQNATAYLLKKQHTKKADWSVHAPALTPGGWGFSDVNTTVPDVDDTTAVLRVLARSRGNEKVDHAWQKGINWVKGLQNNDGGWGAFEKGVTSHILANLPIENASDMITDPSTPDITGRVLEFFGTYAQNELPEKQKQSAINWLMNVQEENGSWYGKWGICYIYGTWAVLTGLRSLGIPSSDPSLKRAALWLEHIQHEDGGWGESCQSSVEKRFVTLPFSTPSQTAWALDALISYYDKETSVIRKGISYLLSNPYINETYPTGTGLPGGFYIRYHSYAHIYPLLTLAHYAKKYRK

SEQ ID NO: 35 - protein, 620 aa, Bacillus cereus
MSNLLLYEKAHEEIVRRATALQTMQWQDGTWRFCFEGAPLTDCHMIFLLKLLGRDKEIEPFVERVASLQTNEGTWKLYEDEVGGNLSATIQSYAALLASKKYTKEDANMKRAENFIQERGGVARAHFMTKFLLAIHGEYEYPSLFHLPTPIMFLQDDAPFSIFELSSSARIHLIPMMLCLNKRFRVGKKLLPNLNHIAGGGGEWFREDRSPVFQTLLSDVKQIISYPLSLHHKGYEEIERFMKERIDENGTLYSYATASFYMIYALLALGHSLQSSMIQKAIAGITSYIWKMERGNHLQNSPSTVWDTALLSYALQEAQVSKDNKMIQNATAYLLKKQHTKKADWSVHAPALTPGGWGFSDVNTTIPDIDDTTAVLRALARSRGNKNIDNAWKKGGNWIKGLQNNDGGWGAFEKGVTSKLLAKLPIENASDMITDPSTPDITGRVLEFFGTYAQNELPEKQIQRAINWLMNVQEENGSWYGKWGICYIYGTWAVMTGLRSLGIPSSNPSLKRAASWLEHIQHEDGGWGESCHSSVEKRFVTLPFSTPSQTAWALDALISYYDTETPAIRKGVSYLLLNPYVNERYPTGTGLPGAFYIRYHSYAHIYPLLTLAHYLKKYRK

SEQ ID NO: 36 - protein, 620 aa, Bacillus cereus
MSNLLLYEKVHEEIARRATALQTMQRQDGTWRFCFEGAPLTDCHMIFLLKLLGRDKEIEPFVKRLASLQTNEGTWKLYEDEVGGNLSATIQSYAALLASQKYTKEDANMKRAENFIKERGGVARAHFMTKFLLAIHGEYEYPSLFHVPTPIMFLQNDSPLSIFELSSSARIHLIPMMVCLNKRFRVGKKLLPNLNHIAGGGGEWFREDRSPLFQTLLSDVKQIISYPLSLHHKGYEEVERFMKERIDENGTLYSYATASFYMIYALLALGHSLQSSMIQKAIAGITSYIWKMERGSHLQNSPSTVWDTALLSYALQEAQVPKDHKMIQQTITYLLKKQHTKKADWSVHAPALTPGGWGFSDVNTTVPDVDDTTAVLRVLARSRENEKVNNAWQKGIDWVKGLQNNDGGWGAFEKGVTSKLLANLPIENASDMITDPSTPDITGRVLELFGTYTQNELPEKQKQSAINWLMNAQEENGSWYGKWGICYIYGTWAVMTGLRSLGIPSNNPSLKRAALWLEHIQHEDGGWGESCQSSMEKRFITLPFSTPSQTAWALDALISYYDTETPAIRKGISYLLANPYVNEKYPTGTGLPGGFYIRYHSYAQIYPLLTLAHYTKKYRK

SEQ ID NO: 37 - protein, 620 aa, Bacillus cereus
MSNLLLYEKAHEEIARRATALQTMQREDGTWRFCFEGAPLTDCHMIFLLKLLGRDKEIEPFVKRLASLQTNEGTWKLYEDEVGGNLSATIQSYAALLASGKYTKEDANMKRAENFIKERGGVARAHFMTKFLLAIHGEYEYPSLFHVPTPIMFLQNDSPLSIFELSSSARIHLIPMMLCLNKRFRVGKKLLPNLNHIAGGGGEWFREERSPLFQTLLSDVKQIISYPLSLHHKGYEEVERFMKERIDENGTLYSYATASFYMIYALLALGHSLQSSMIQKAIAGITSYIWKMESGNHVQNSPSTVWDTALLSYALQEAHVPKDNKMLQNATAYLLKKQHTKKADWSVHAPALTPGGWGFSDVNTTVPDVDDTTAVLRVLARSKGNEKLDHAWQKGINWVKGLQNNDGGWGAFEKGVTSRILANLPIENASDMITDPSTPDITGRVLEFFGTYAQNELPEKQKQSAINWLMNAQEENGSWYGKWGICYIYGTWAVMTGLRSFGIPSSNPSLKRAALWLEHIQHKDGGWGESCHSSVEKRFVTLPFSTPSQTAWALDALISYYDTETPVIRKGISYLLANPYVNEKYPTGTGLPGGFYIRYHSYAHIYPLLTLTHYIKKYRK

SEQ ID NO: 38 - protein, 620 aa, Bacillus cereus
MSNLLLYEKAHEEIARRATALQSMQWQDGTWRFCFEGAPLTDCHMIFLLKLLGRDKEIEPFVKRLASLQTNEGTWKLYEDEVGGNLSATIQSYAALLASGKYTKEDANMKRAENFIKERGGVARAHFMTKFLLAVHGEYEYPSLFHLPTPIMFLQNDSPLSIFELSSSARIHLIPMMLCLNKRFRVGKKLLPNLNHIAGGGGEWFREERSPLFQTLVSDVKQIISYPLSLHHKGYEEVERFMKERIDENGTLYSYATASFYMIYALLALGHSLQSSIIQNAITGITSYIWKMESGNHLQNSPSTVWDTALLSYALQEAHVPKDNKMLQNATAYLLKKQHTKKADWSVHASALTPGGWGFSDVNTTVPDVDDTTAVLRVLARSRGNEKVDHAWQKGINWVKGLQNNDGGWGAFEKGVTSNILAKLPIENASDMITDPSTPDITGRVLEFFGTYAQNELPEKQKQSAINWLMNVQEENGSWYGKWGICYIYGTWAVMTGLRSFGIPSSNPSLKRAALWLEHIQHKDGGWGESCHSSVEKRFVTLPFSTPSQTAWALDALISYYDTETPIIRKGISYLLANPYVNEKYPTGTGLPGGFYIRYHSYAHIYPLLTLAHYIKKYRK

SEQ ID NO: 39 - protein, 620 aa, Bacillus cereus
MNNLLLYEKVHEEIARRATALQTMQQQDGTWRFCFEGAPLTDCHMIFLLKLLGRDKEIEPFVKRLASLQTNEGTWKLYEDEVGGNLSATIQSYAALLASKKYTKEDANMKRAENFIKERGGVARAHFMTKFLLAIHGEYEYPSLFHLPTPIMFLQNDSHLSIFELSSSARIHLIPMMLCLNKRFRVGKKLLPSLNHIAGGGGEWFREDRSPLFQTLVSDVKQIISYPLSLHHKGYEEVERFMKERIDENGTLYSYATASFYMIYALLALGHSLQSTMIQKAITGITSYIWKMESGNHLQNSPSTVWDTALLSYALQEAHVPKDNKMIQHAATYLLKKQHTQKADWSVHAPALTPGGWGFSDVNTTIPDVDDTTAVLRALARSRGNEKVDNAWPKGINWVKGLQNNDGGWGAFEKGVTSNILANLPIENASDMITDPSTPDITGRVLEFFGKYAQNELPEKQKQSAINWLMNVQEENGSWYGKWGICYIYGTWAVMTGLRSLGIPSSNPSMKRAALWLEHIQHEDGGWGESCHSSVEKRFVTLPFSTPSQTAWALDALISYYDKETSIIRKGISYLLANPYVNEKYPTGTGLPGGFYIRYHSYAHIYPLLTLAHYIKKYRK

SEQ ID NO: 40 - protein, 620 aa, Bacillus cereus
MSNLLLYEKVHEEIARRTTALQTMQRRDGTWRFCFEGAPLTDCHMIFLLKLLGRDKEIEPFVKRLASLQTNEGTWKLYEDEVGGNLSATIQSYAALLASKKYTKEDANMKRAEMFINERGGVARAHFMTKFLLAVHGEYEYPSLFHLPTPIMFLQSDSPLSIFELSSSARIHLIPMMLCLNKKFRIRKKLLPNLNHISGGGGEWFRGNRSPLFQTLVSDVKQIISYPLSLHHKGNEEVERFMKERIDENGTLYSYATASFYMIYALLALGHSLQSTMIQKAITGITSYIWNMESGNHLQNSPSTVWDTALLSYALQEAHVPKDTNMLQHATAYLLKKQHTKKADWSVHAPALAPGGWGFSDVNTTIPDVDDTTAVLRALARSRGSEKVDYVWEKGINWVKGLQNNDGGWGAFEKGVTSNLLANLPIENASDMITDPSTPDITGRVLELFGTYAQNELPEKQTQSAINWLMNVQEKNGSWYGKWGICYIYGTWAVMTGLRSLGIPSSNPSLKRAALWLEHIQHEDGGWGESCHSSVEKRFVTLPFSTPSQTAWALDALISYYDKETPAIRKGISYLLANRYVNEKYPTGTGLPGGFYICYHSYAHIYPLLTLAHYIKKYRK

SEQ ID NO: 41 - protein, 620 aa, Bacillus cereus
MSNLLLYEKVHEEIARRTTALQTMQRQDGTWQFCFEGAPLTDCHMIFLLKLLGRDKEIEPFVKRLASLQTNEGTWKLYEDEMGGNLSATIQSYAALLASEKYTKEDANMKRAEMFINERGGVARAHFMTKFLLAIHGEYEYPSLFHLPTPIMFLQNDSPLSIFELSSSARIHLIPMMLCLNKRFRVGKKLLPNLNHIAGGGGEWFREDRSPVFQTLVSDVKKIITYPLSLHHKGYEEVERFMKERIDENGTLYSYATASFYMIYALLALGHSIQSPIIQKAITGITSYIWKMERGSHLQNSPSTVWDTALLSYVLQEAQVPKASKVIHNASAYLLRKQQTKKVDWSVHAPDLFPGGWGFSDVNTTIPDIDDTTAALRALARSRGNENVDTAWKRAVNWVKGLQNNDGGWGTFEKGVTSRILANLPIENASDMITDPSTPDITGRVLEFFGTYTQNELPEKQKQSAINWLMNVQEENGSWYGKWGICYIYGTWAVLTGLRSLGIPSSDPSVKRAALWLEHIQHEDGGWGESCQSSVEKRFVTLPFSTPSQTAWALDALISYYDKETPVIRKGISYLLSNSYINEKYPTGTGLPGGFYIRYHSYAHIYPLLTLAHYAKKYRK

SEQ ID NO: 42 - protein, 620 aa, Bacillus cereus
MSNLLLYEKVHEEIARRTTALQTMQRQDGTWRFCFEGAPLTDCHMIFLLKLLGRDKEIEPFVKRLASLQTNEGTWKLYEDEVGGNLSATIQSYAALLASEKYTKEDANMKRAEMFINERGGVARAHFMTKFLLAIHGEYEYPSLFHLPTPIMFLQNDSPLSIFELSSSARIHLIPMMLCLNKRFRVGKKLLPNLNHIAGGGGEWFREDRSPVFQTLVSDVKKIITYPLSLHHKGYEEVERFMKERIDENGTLYSYATASFYMIYALLALGHSIQSPIIEKAIMGITSYIWKVERGSHLQNSPSTIWDTALLSYALQEAQVPKASKVIQNASAYLLRKQQTKKVDWSVHAPDLFPGGWGFSDVNTTIPDIDDTTAVLRALARSRGNEHVDNAWKRAVNWVKGLQNNDGGWGAFEKGVTSRILANLPIENASDMITDPSTPDITGRVLEFFGTYTQNELPEKQKQSAINWLMNVQEENGSWYGKWGICYIYGTWAVLTGLRSLGIPSSDSSLKRAVLWLEHIQHEDGGWGESCQSSVEKRFVTLPFSTPSQTAWALDALISYYDKETPVIRKGISYLLSNPYINEKYPTGTGLPGGFYIRYHSYAHIYPLLTLAHYAKKYRK

SEQ ID NO: 43 - protein, 620 aa, Bacillus cereus
MNALLLYEKVHEEIARRTTALQTMQRQDGTWRFCFEGAPLTDCHMIFLLKLLGRDKEVEPFVKRLASLQTNEGTWKLYDDEMGGNLSATIQSYAALLASKKYTKEDANMKRAEMFITERGGVARAHFMTKFLLAIHGEYEYPSLFHLPTPIMFLQNDSPLSIFELSSSARIHLIPMMLCLNKRFRVGKKLLPNLNHIAGGGGEWFREDQSPMFQTLLGNVKQIISYPLSLHHKGNEEVERFMKERIDENGTLYSYASASFYMIYALLALGHSIQSPMIQKAITGITSYIWKMERGNHLQNSPSTVWDTALLSYALQEARVSKESKMIQNASAYLLKKQHKKKADWSVHAPVLIPGGWGFSDVNTTVPDVDDTTAVLRALAQSRGNGNVDDAWKKGTNWIKGLQNNDGGWGAFEKGVTSKLLANLPIENASDMITDPSTPDITGRVLEFFGTYTQNELPEKQKQSAINWLMNEQEENGSWYGKWGICYIYGTWAVMTGLRALGITSAHPSLKRATLWLEHIQHEDGGWGESCQSSVEKRFATLPFSTPSQTAWALDALISYYDKETPAIRKGISYLLANPYVNEKYPTGTALPGGFYIHYHSYAHIYPLLTLAHYAKKYKK

SEQ ID NO: 44 - protein, 620 aa, Bacillus cereus
MSGVLLYDKVHEEIERRTTALQTMQRQDGTWQFCFEGALLTDCHMIFLLKLLGRNDEIEPFVKRLASLQTNEGTWKLYEDEKGGNLSATIQAYAALLASEKYSKEDMNMRRAEMFIKEHGGVSRAHFMTKFLLAIHGEYEFPALFHFPTPILFLQDDSPLSIFGLSSSARIHLIPMMICMNKRFRVEKKLLPNLNHIAGGGGQWFREERSPLFQSLLGDVKKVISYPLSLHHKGYEEVERFMKERIDENGTLYSYASATFYMIYALLALGHSIQSPIIEKAVTGLKSYIWKMDRGSHLQNSPSTVWDTALLSYSLQEAKVTNENKMIQRATEYLLQKQQTKKVDWSVHASSLVAGGWGFSDVNTTIPDIDDTTAALRALARSRGNDRVDDAWGRGVEWVKGLQNNDGGWGAFERGVTSKLLSNLPIENASDMITDPSTPDITGRVLELFGTYAPNELLEEQKKKAIKWLMDVQEQNGSWYGKWGICYIYGTWATMTGLRALGVPSTHPSLKKAASWLEHLQHEDGGWGESCQSSVEKKFISLPFSTPSQTAWALDALISYYDQETPIIRKGITYLLAQSTMNEKYPTGTGLPGGFYIRYHSYGHIYPLLALAHYVKKYRK

SEQ ID NO: 45 - protein, 620 aa, Bacillus cereus
MSGVLLYDKVREEIERRTTALQTMQRQDGTWSFCFEGALLTDCHMIFLLKLLGRNDEIEPFVKRLASLQTNEGTWKLYEDENGGNLSATIQAYAALLASEKYSKEDINMRRAEMFIKEHGGVSRAHFMTKFLLAIHGEYEFPTLFHFPTPILFLQDDSPLSIFELSSSARIHLIPMMICMNKRFRVEKKLLPNLNHIAGEGGQWFREERSPLFQSFVGDVKKVIAYPLSLHHKGYEEVERFIGERIDENGTLYSYASATFYMIYALLALGHSIQSPIIEKAVIGLKSYIWKMDRGSHLQNSPSTVWDTALLSYSLQEANVMKENKMIQKATEYLLQRQQTKRMDWSVHAPSIMAGGWGFSDVNTTIPDVDDTTAALRALARSRGSSRVDSAWERGVEWLKGLQNNDGGWGAFERGVTSRILANLPIENASDMITDPSTPDITGRVLEFFGTYAPNELPEEQKKKAVKWLMDVQELNGSWYGKWGICYIYGTWAAMTGLRALGVPSSHPSLKKAASWLEHLQYEDGGWGESCQSSVEKKFISLPFSTPSQTAWALDALISYYDQETPIIRKGISYLLAQPTMNEKYPTGTGLPGGFYIRYHSYGHIYPLLALAHYIKKYKK

SEQ ID NO: 46 - protein, 619 aa, Bacillus cereus
MLLYEKVHEEVKEKMAALQAMQQQDGTWRFCFEGSPLTDCYMIFLLTLLGQDQEIEPFVARLAALQTNEGTWKLYEDEPDGNLSATIQAYAALLVSKMYKKEDINMKRAEVFIRKQGGITKAHFMTKFLLALHGGYEYPPLFHFPTPILFLSEDSPLSIFELSSSARIHLIPMMLCMNKRFTVSKKMLPNLDYISGGSKEQWFREERSPLFQTLLRDVTKFLSYPLSLHYKGDKAAERFMIERIDTNGTLYSYASATFYMIYALLALGHSIQSPLISNAVLGLKTYVWNMDRWAHLQNSPSTVWDTALLSYSLQEARVPHDNEMIQKAINYLLQKQHKEKKDWSVHAPTLDAGGWGFSDVNTTIPDVDDTTAVLRALAGSRQGNPKVESAWRKGIEWVKGLQNSDGGWAAFEKGVTSKVLTHLPLDNSGDMITDPSTVDITGRVLEFFGTYAPNELQGDQKDRAIRWLIYTQEKNGSWHGKWGVCYIYGTWAALTGLRAVGVPSNHIALQKAATWLESIQHSDGGWGESCRSSVEKKFISLPFSTPSQTAWALDALIACYDSETPTIRKGISYLLKHSTKHQEYPTGTALANGFYIRYHSYHHIFPLLTFAHYIKKYRK

SEQ ID NO: 47 - protein, 617 aa, Bacillus cereus
MLLYEKVHEEIVRRATALQTMQWQDGTWRFCFEGAPLTDCHMIFLLKLLGREKEIEPFVERIASLQTNEGTWKLYEDEVGGNLSATIQSYAALLASKKYTKEDANMKRAENFIKERGGVARAHFMTKFLLAIHGGYEYPSLFHLPTPIMFLQNDSPLSIFELSSSARIHLIPMMLCLNKRFRVGKKLLPNLNHIAGGGGEWFREDRSPVFQTLISDVKQIISYPLSLHHKGYEEIERFMKERIDENGTLYSYATASFYMIYALLALGHSPQSSMIQKAIAGLTSYIWKMGRGSHLQNSPSTVWDTALLSYALQEARVSKDNKMIQNATAYLLKKQHTKKADWSVHAPALIPGGWGFSDVNTTIPDIDDTTAVLRALARSRGNKNIDNAWQKGVNWIKGLQNNDGGWGAFEKGVTSKLLANLPIENASDMITDPSTPDITGRVLEFFGTYAQNGLPEKQKQSAINWLMNAQEENGSWYGKWGICYIYGTWAVMTGLRSLGIPSSNPSLKRAASWLEYIQHEDGGWGESCHSSVEKRFVTLPFSTPSQTAWALDALISYYDTETPAIRKGVSYLLSNPYVNERYPTGTGLPGAFYIRYHSYAHIYPLLTLAHYLKKYRK

SEQ ID NO: 48 - protein, 617 aa, Bacillus cereus
MLLYEKAHEEIARRATALQTMQRQDGTWRFCFEGAPLTDCHMIFLLKLLGRDKEIEPFVKRLASLQTNEGTWKLYEDEVGGNLSATIQSYAALLASKKYTKEDANMKRAENFIKERGGVARAHFMTKFLLAIHGEYEYPSLFHLPTPIMFLQNDSPLSIFELSSSARIHLIPMMVCLNKRFRVGKKLLPNLNHIAGGGGEWFREDRSPLFQTLLSDVKQIISYPLSLHHKGYEEVERFMKERIDENGTLYSYATASFYMIYALLALGHSLQSSLIQKAIAGITSYIWKMERGSHLQNSPSTVWDTALLSYALQEAHVPKDHKMIQQTITYLLKKQHTKKADWSVHALALTPGGWGFSDVNTTIPDVDDTTAVLRALARSRGNENIDNAWKKGVNWIKGLQNNDGGWGAFEKGVTSKLLANLPIENASDMITDPSTPDITGRVLELFGTYTQNELPKKQKQSAINWLMNVQERNGSWYGKWGICYIYGTWAVMTGLRSLGIPSNNPSLKRAALWLEHIQHEDGGWGESCQSSVEKRFVTLPFSTPSQTAWALDALISYYDKETPTIRKGVSYLLANPYVNEKYPTGTGLPGGFYIRYHSYAQIYPLLTLAHYTKKYQK

SEQ ID NO: 49 - protein, 617 aa, Bacillus cereus
MLLYEKVYEEIARRTTALQTMQRQDGTWRFCFEGAPLTDCHMIFLLKLLGRDKEIEPFVKRLASLQTNEGTWKLYEDEVGGNLSATIQSYAALLASEKYTKEDANMKRAEMFINERGGVARAHFMTKFLLAIHGEYEYPSLFHLPTPIMFLQNDSPLSIFELSSSARIHLIPMMLCLNKRFRVGKKLLPNLNHIAGGGGEWFREDRSPVFQTLLSEVKKIITYPLSLHHKGYEEVERFMKERIDENGTLYSYATASFYMIYALLALGHSIQSPIIQKAITGIASYIWKMERGSHLQNSPSTVWDTALLSYALQEAQVPKASKVIQNASAYLLRKQQTKKVDWSVHAPNLFPGGWGFSDVNTMIPDIDDTTAVLRALARSRGDENVDNAWKRAVNWVKGLQNNDGGWGAFEKGVTSRILANLPIENASDMITDPSTPDITGRVLEFFGTYAQNELPEKQKQSAINWLMNVQEENGSWYGKWGICYIYGTWAVLTGLRSLGIPSSDPSLKRAALWLEHIQHEDGGWGESCQSSVEKRFVTLPFSTPSQTAWALDALISYYEKETPIIRKGISYLLSNPYVNEKYPTGTGLPGGFYIRYHSYAHIYPLLTLAHYTKKYRK

SEQ ID NO: 50 - protein, 486 aa, Bacillus coahuilensis
MAEAISYPRRVHIITTKFPVNFYDFSVFGRSNIAPILLLADSKFQIPKTTETPDISHLYVRELYWWSEDRGWNGFTKAINKGVNNLIGLPNELHTLGRKQAENYMLDRLEDDGTLLSYYSSTFFMIYALLSVGYTKDHKVIKKAARGLLSMNTTVKDTIHIQYTTAHIWNTSLISHALQTAGASPDDTMVMRANHYLLQRQHTKFGDWAIYQPNLGPGGWGFSHSNTFNPDVDDTTASLRSIQNSLHSHPNYQSSWYRGLSFTLGMQNQDGGFPAFEKGVDKTFLHLLPVQGAEFLLTDPSTPDLTGRTLEFLGESAHLYKDSGAIKRGVNWLIENQRRDGSWYGRWGICYIYGTWAALTGLQAVGVSKEHPSVQEGIDWLKSIQQDDGGWGESCESDSQKTYIPLSKSTVTQTAWAVDALIAYEKEETVEIKKGMEYLLENWNHEDWTMDYPMGQGMAKAFYIHYHSYRYVFPLLTMGHYMRKFM

SEQ ID NO: 51 - protein, 619 aa, Bacillus cytotoxicus
MVLYGRVCAEIERTITALHTMQQQDGAWRFCFEGSPLTDCHMIFLLRLLEKEEEIEPFVARLTSIQTNEGTWKLYEDERAGNVSTTIQAYAALLASGMYTKEDVNMKRAEAFIQERGGIARSHFMTKFLLALHGGYEYPRMFYFPTPILFLPEDSPLSIFELSSSARIHLIPMMICMNKRFTVSKTILPNLDHISGSSKSEWFREDRSSLFETILGEVKKFVTYPLSLHHKGDKEAERFMIERIDRNGTLYSYASATFYMIYALLALGHHIQSPLIQQAVAGLRTYKWHMEAGIHLQNSPSTVWDTALLSYALQEANVNESTPMIQTATEYIWQRQHHEKKDWSLHAPTLSPGGWGFSDVNTTIPDVDDTTAALRALARSRKRNRRIEEAWKKGVNWVKGLQNKDGGWAAFEKGVTNRFLTHLPLENSGDMMTDPSTADITGRVLEFFGTYAPNELQDHQKNRAITWLMDVQENNGSWYGKWGVSYIYGTWAALTGLRAVGVANTHPALKKAVMWLERIQHRDGGWGESCRSSIEKRFVPLSFSTPSQTAWAIDALISYYDEETPVIRKGISYLLEHAASHQEYPTGTGLPNGFYIRYHSYSYMYPLLTFAHYINKYRK

SEQ ID NO: 52 - protein, 629 aa, Bacillus licheniformis
MRSILEDVKAFRQKTLAELQNRQRSDGSWRFCFEGPVMTDSFFILMLTSLGDQDSSLIASLAERIRSRQSEDGAFRNHPDERAGNLTATVQGYTGMLASGLYDRKAPHMQKAEAFIKDAGGLKGVHFMTKWMLAANGLYPWPRAYIPLSFLLIPSYFPLHFYHFSTYARIHFVPMAITFNRRFSLKNNQIGSLRHLDEAMSKNPLEWLNIRAFDERTFYSFNLQWKQLFQWPAYVHQLGFEAGKKYMLDRIEEDGTLYSYASATMFMIYSLLAMGISKNAPVVKKAVSGIKSLISSCGKEGAHLENSTSTVWDTALISYAMQESGVPEQHSSTSSAADYLLKRQHVKKADWAVSNPQAVPGGWGFSHINTNNPDLDDTAAALKAIPFQRRPDAWNRGLAWLLSMQNKDGGFAAFEKDVDHPLIRNLPLESAAEAAVDPSTADLTGRVLHLLGLKGRFTDNHPAVRRALRWLDHHQKADGSWYGRWGVCFIYGTWAALTGMKAVGVSANQTSVKKAISWLKSIQREDGSWGESCKSCEAKRFVPLHFGTVVQSSWALEALLQYERPDDPQIIKGIRFLIDEHESSRERLEYPTGIGLPNQFYIRYHSYPFVFSLLASSAFIKKAEMRETY

SEQ ID NO: 53 - protein, 620 aa, Bacillus mycoides
MSGVLLYDKVHEEIERRTTALQTMQRQDGTWQFCFEGALLTDCHMIFLLKLLGRNDEIEPFVKRLVSLQTNEGTWKLYEDEKGGNLSATIQAYAALLASERYSKEAMNMRRAEMFIKEHGGVSRAHFMTKFLLAIHGEYEFPALFHFPTPILFLQDDSPLSIFGLSSSARIHLIPMMICMNKRFRVEKKLLPNLNHIAGGGGQWFREERSPLFQSFLGDVKKVISYPLSLHHKGYEEVERFMKERIDENGTLYSYASATFYMIYALLALGHSIQSPIIEKAVTGLKSYIWKMDRGSHLQNSPSTVWDTALLSYSLQEAKVTNENKMIQRATEYLLQKQQTKKVDWSVHASSLVAGGWGFSDVNTTIPDIDDTTAALRALARSRGNDRVDDAWGRGVEWVKGLQNNDGGWGAFERGVTSKLLSNLPIENASDMITDPSTPDITGRVLELFGTYAPNELLEEQKKKAIKWLMDVQEQNGSWYGKWGICYIYGTWATMTGLRALGVPSTHPALKKAASWLEHLQHEDGGWGESCQSSVEKKFISLPFSTPSQTAWALDALISYYDQETPIIRKGISYLLAQSTMNEKYPTGTGLPGGFYIRYHSYGHIYPLLALAHYVKKYRK

SEQ ID NO: 54 - protein, 619 aa, Bacillus mycoides
MLLYEKVRQEVERKVTALRTTQYQDGAWRFCFEGSPLTDCHMIFLLRLLGQNGEMEPFVTRVASLQTNEGTWKLYEDESVGNLSTTINAYVALLASGRYTKEDINMKRAEAFIRRQGGITKAHFMTKFLLALHGGYEYPSLFHFPTPMLFLPEDSPLSIFELSSSARIHLIPMMICMNKRFTVSKTIFPNLDYISGGSKKQWFREERSPLFQTLLGDVKKFLSYPLSLQHKGYKEAERFMIERIETNGTLYSYASATFYMIYALLALGHSIQSPLISNAVLGLKSYIWNMNKGTHLQNSPSTVWDTALLSYSLQEAGVPNDNQMIQKATDYLLQKQHKEKKDWSVHAPSLDAGGWGFSDVNTTIPDIDDTTAALRAIARSREGNQRIEEDWRKGIEWVKGLQNIDGGWAAFERGVTSHFLTHLPLDNAGDMTTDPSTSDITGRVLEFFGTYAPHQLKDDQKDRAIKWLMQAQEKNGSWYGKWGVCYIYGTWAVLTGLRAVGVPSNHTALQKAATWLERIQHNDGGWGESCRSSIEKHFISLPFSTPSQTAWALDALITFYDTETPVIRKGISYLLAHLNQNQDYPTGIGLPDGFYIRYHSYHHIFPILTFAHYIKKYMK

SEQ ID NO: 55 - protein, 619 aa, Bacillus pseudomycoides
MLLYEKVRQEVERKVTALRTMQYQDGAWRFCFEGSPLTDCHMIFLLRLLGQNGEMEPFVTRVASLQTNEGTWKLYEDESVGNLSTTINAYVALLASGRYTKEDINMKRAEAFIRRQGGITKAHFMTKFLLALHGGYEYPSLFHFPTPMLFLPEDSPLSIFELSSSARIHLIPMMICMNKRFTVSKTILPNLDYISGGSKKQWFREERSSLFQRLLGDVKKFLSYPLSLQHKGYKEAERFMIERIETNGTLYSYASATFYMIYALLALGHSIQSPLISNAVLGLKSYIWNMNKGTHLQNSPSTVWDTALLSYSLQEAGVPNDNQMIQKATDYLLQKQHKEKKDWSVHAPSLDAGGWGFSDVNTTIPDIDDTTAALRAIARSREGNQRIEEAWRKGIEWVKGLQNIDGGWAAFERGVTSHFLTHLPLDNAGDMTTDPSTSDITGRVLEFFGTYAPHQLKDDQKDRAIKWLMQAQEKNGSWYGKWGVCYIYGTWAALTGLRAVGVPSNHTALQKAATWLERIQHNDGGWGESCRSSIEKHFISLPFSTPSQTAWALDALITFYDTETPVIRKGISYLLAHLNQNQDYPTGIGLPDGFYIRYHSYHHIFPILTFAHYIKKYMK

SEQ ID NO: 56 - protein, 624 aa, Bacillus pumilus
MQDFKTKVNVYMDELHMQMQHRQREDGAFVFCFEGSMMTNAFLIMLLKAVGDTDQALVHQLAEAIREKQNEDGSFSLYHDQAGHVTATVQGYCGMLVSGRYQQDEPHMEKAARYIRSKGGLKDVHFMTKWMLAVNGMHPWPYFYAPLSFLLIPTYFPLHFYHLSAYARIHFVPMMIALNKRYTSHEQFPSLSHLDANMSKNPFDWFMAREERSTHHFLAYMRSYTALDSRFDFFGYEAAKRYMFDRLEKDGTLYSYLSASIFMVYALMSLGYSPGHHLILKAVKGMKQLVTDCGGKKYAENSTSTVWDTALVSYASQRAGRTQDDPVIKKSFTYLLNRQQMKKADWAIHNRHAAPGGFGFSDLNTNNPDCDDTQIVLKAIPQTYAPVQWKRGFDWLLSMQNRDGGFSAFEKNQDHFLLRHLPLESAEDAAIDPSTPDITGRVLHLIASEENDKSPLMQRQKDHCVKWLLDHQEKDGSWYGRWGVCYIYGTWAALTGLKASGIPSSHPAVQKACRFLKTIQLEDGSFGESCKSSEVKRYVPLPFGTVVQTAWAAEALLQYVQPDDKSILKAISFLIQHQHSSKALHYPVGIGLPKQFYITYHSYPFVFPMMACSTFLEEMRRKNE

SEQ ID NO: 57 - protein, 624 aa, Bacillus pumilus
MQDFKTKVNEYIDELHMQLQRRQREDGAFVFCFEGPMMTNAFLIMLLKAVGDSDQALVHQLAEAIREKQNEDGSFSLYHDQAGHVTATVQGYCGMLVSGRYQQDEPHMEKAAHFIRSNGGLKDVHFMTKWMLAVNGMHPWPYFYAPLSFLLIPTYFPLHFYHLSAYARIHFVPMMIALNKRYTSHEQFPSLAHLDANMSKNPFDWFMAREERSTHHFLAYMRSYTALDSRLDFFGYEAAKRYMFDRLEKDGTLYSYLSASIFMVYALMSLGYSPGHHLILKAVKGMKQLVTDCGGRKYAENSTSNVWDTALVSYASQQAGRTQDDPVIKKSFTYLLNRQQMKKADWAIHNRHAAPGGFGFSDLNTNNPDCDDTQIVLKAVPQTYAPVQWKRGFDWLLSMQNQDGGFSAFEKNQNHFLLRHLPLESAEDAAIDPSTPDIAGRVLHLIALEENSMSPLMQRQKDHCVKWLLDHQEKNGSWFGRWGVCYIYGTWAALTGLKTAGISSSHSAVQKACRFLKTIQLEDGSFGESCKSAEVKRYVPLPFGTVVQTAWAAEALLQYVQPDDKVILKAISFLIQHQHSSEALHYPVGIGLPKQFYITYHSYPFVFPMMACSTFLEEMRRKNE

SEQ ID NO: 58 - protein, 638 aa, Bacillus sp.
MKNRNKGAGCMQLVKSEIERLKQQLLSEQTPDGSWNHPFDTGCMTDIYMIVLLRTLEEEDEEELIKELAKGILSRQGKDGAWRLFHDHHEGSLSLTIEAYYALLYSGYYEKNHPALVKARRVITKGGGLKKAGMYTKIMLALTGQYPWPLLFPVPMEVILLPRSFPLNMYDISVFGRSNLIPVILLGNKKFSRKTALSPDLGDLSVRDDDDPWPELRSAEWRSLTSFLAAGVKALVGIPRQIRAWSIEKAREYMQSHTEPDGTLYNYFSSTFYMIFALLALGGGPEEPAIRNAVAGLKRMTVKADGRTHIQYTTAAVWNTALISHALQEAGVPPKENAIQKANQYLAGQQHRRFGDWIVHNTKAEPGGWGFSRFNTINPDVDDTTAALRSLYQPAREKPHYDDIWKKGLLWTLSMQNRDGGWPAFERNVDKKLLHLLPIQGAEFILTDPSTADLTGRTLEFLGKAGYADASLPPIKKAVKWLKKHQEPNGSWYGRWGICYIYGTWAAVTGMAAVGVTLEDKSMKKGIDWLLSIQNEDGGWGESCRSDMEKKYIPLKESTLTQTAWAVDALAAAGMADSTPSRKGAAFLVREGKRKDWTADYPMGQGMANFFYIHYHSYRCIWPLLALSHYIEKSEAPD

SEQ ID NO: 59 - protein, 625 aa, Bacillus sp.
METLIDPEISRLTQRLLEDQEEDGAWRYCFENSLMTDAYMIVLIRSLGIKKERLVQELADRLLSQQEEKGFWKIYRDEVEGNLSATVEAYFALLWSGAVKEKDENMVKARDCILSGGGLDKVHSMTKFMLAAHGQYPWDRFFPVPVEVILLPTYFPVSFTDFSAYARVHLAPLLLLKSERYIRKTSTTPDLSYLLKDQEDFSFFREEERSFIEYVTSGVEAIAAFPANLNDLAKKTALNYMLARLEPDGSLYSYFSSSFYMIIALLSQGYSRKDPLVVNAIKALISYQCKGDGYPHIQNSPSTIWDTALISHALQSSGVDSRNAQILKASHYLYRHQHTQKGDWASEAPQTAPGGWGFSESNTINPDVDDTTAALRALKLDAYTDPVKRMAWNRGVKWALSMQNKDGGWPAFEKNKNKDILSWVPMDGAEDAALDRSCADLTGRTLEFLGNDAGMGRENSQVLKGIEWLMNNQENDGSWYGKWGICYIYGTWAALTGMMAAGMSADHQSIIKAIKWLYQIQNSDGGWGESCRSDKERKYISLGASTPSQTAWALDALISINDHPTKEIDRGIESLVRLLNTDDWRKEYPTGAGLPGRFYIHYHSYPYIWPLLALSNYKTKFLEVR

SEQ ID NO: 60 - protein, 632 aa, Bacillus subtilis
MGTLQEKVRRFQKKTITELRDRQNADGSWTFCFEGPIMTNSFFILLLTSLDEGENEKELISSLAAGIHAKQQPDGTFINYPDETRGNLTATVQGYVGMLASGCFHRTEPHMKKAEQFIISHGGLRHVHFMTKWMLAANGLYPWPALYLPLSLMALPPTLPIHFYQFSSYARIHFAPMAVTLNQRFVLINRNISSLHHLDPHMTKNPFTWLRSDAFEERDLTSILLHWKRVFHAPFAFQQLGLQTAKTYMLDRIEKDGTLYSYASATIYMVYSLLSLGVSRYSPIIRRAITGIKSLVTKCNGIPYLENSTSTVWDTALISYALQKNGVTETDGSVTKAADFLLERQHTKIADWSVKNPNSVPGGWGFSNINTNNPDCDDTTAVLKAIPRNHSPAAWERGVSWLLSMQNNDGGFSAFEKNVNHPLIRLLPLESAEDAAVDPSTADLTGRVLHFLGEKVGFTEKHQHIQRAVKWLFEHQEQNGSWYGRWGVCYIYGTWAALTGMHACGVDRKHPGIQKALRWLKSIQNDDGSWGESCKSAEIKTYVPLHRGTIVQTAWALDALLTYENSEHPSVVKGMQYLTDSSSHSADSLAYPAGIGLPKQFYIRYHSYPYVFSLLAVGKYLDSIEKETANET

SEQ ID NO: 61 - protein, 556 aa, Bacillus subtilis
MGTLQEKVRRFQKKTITELRDRQNADGSWTFCFEGPIMTNSFFILLLTSLDEGENEKELISSLAAGIHAKQQPDGTFINYPDETRGNLTATVQGYVGMLASGCFHRTEPHMKKAEQFIISHGGLRHVHFMTKWMLAANGLYPWPALYLPLSLMALPPTLPIHFYQFSSYARIHFAPMAVTLNQRFVLINRNISSLHHLDPHMTKNPFTWLRSDAFEERDLTSILLHWKRVFHAPFAFQQLGLQTAKTYMLDRIEKDGTLYSYASATIYMVYSLLSLGVSRYSPIIRRAITGIKSLVTKCNGIPYLENSTSTVWDTALISYALQKNGVTETDGSVTKAADFLLERQHTKIADWSVKNPNSVPGGWGFSNINTNNPDCDDTTAVLKAIPRNHSPAAWERGVSWLLSMQNNDGGFSAFEKNVNHPLIRLLPLESAEDAAVDPSTADLTGRVLHFLGEKVGFTEKHQHIQRAVKWLFEHQEQNGSWYGRWGVCYIYGTWAALTGMHACGLTESIPVYKRLCVGSNPYKMMTEAGENPAKAPKSKHMYRFIEEPLYKRPGL

SEQ ID NO: 62 - protein, 631 aa, Bacillus thuringiensis
MNIVIRISKGWVSNLLLDEKAHEEIVRRATALQTMQWQDGTWRFCFEGAPLTDCHTIFLLKLLGRDKEIEPFVERVASLQTNEGTWKLYEDEVGGNLSATIQSYAALLASKKYTKEDANMKRAENFIQERGGVARAHFMTKFLLAIHGEYEYPSLFHVPTPIMFLQNDSPFSIFELSSSARIHLIPMMLCLNKRFRVGKKLLPNLNHIAGGGGEWFREDRSPVFQTLLSDVKQIISYPLSLHHKGYKEIERFMKERIDENGTLYSYATASFYMIYALLALGHSLQSSMIQKAIAGITSYIWKMERGNHLQNSPSTVWDTALLSYALQEAQVSKDNKMIQNATAYLLKKQHTKKADWSVHAQALTPGGWGFSDVNTTIPDIDDTTAVLRALARSRGNKNIDNAWKKGVNWIKGLQNNDGGWGAFEKGVTSKLLAKLPIENASDMITDPSTPDITGRVLEFFGTYAQNELPEKQIQRAINWLMNVQEENGSWYGKWGICYIYGTWAVMTGLRSLGIPSSNPSLTRAASWLEHIQHEDGGWGESCHSSVEKRFVTLPFSTPSQTAWALDALISYYDTETPAIRKGVSYLLSNPYVNERYPTGTGLPGAFYIRYHSYAHIYPLLTLAHYIKKYRK

SEQ ID NO: 63 - protein, 653 aa, Bacillus thuringiensis
MSNLLLYEKAHEEIARRATALQTMQREDGTWRFCFEGAPLTDCHMIFLLKLLGRDKEIEPFVKRLATLQTNEGTWKLYEDEVGGNLSATIQSYAALLASGKYTKEDANMKRAENFIKERGGVARAHFMTKFLLAIHGEYEYPSLFHVPTPIMFLQNDSPLSIFELSSSARIHLIPMMLCLNKRFRVGKKLLPNLNHIAGGGGEWFREERSPLFQTLLSDVKQIISYPLSLHHKGYEEVERFMKERIDENGTLYSYATASFYMIYALLALGHSLQSSMIQKAIAGITSYIWKMESGNHVQNSPSTVWDTALLSYALQEAHVPKDNKMLQNATAYLLKKQHTKKADWSVHAPALTPGGWGFSDVNTTVPDVDDTTAVLRVLARSKGNEKLDHAWQKGINWVKGLQNNDGGWGAFEKGVTSRILANLPIENASDMITDPSTPDITGRVLEFFGTYAQNELPEKQKQSAINWLMNAQEENGSWYGKWGICYIYGTWAVMTGLRSFGIPSSNPSLKRAALWLEHIQHKDGGWGESCHSSVEKRFVTLPFSTPSQTAWALDALISYYDTETPVIRKGISYLLANPYVNEKYPTGTGLPGGFYIRYHSYAHIYPLLTLTHYIKNIENKPRDISRFIFLGSRSLLKRIRLCFPYFSVDWRF

SEQ ID NO: 64 - protein, 620 aa, Bacillus thuringiensis
MSNLLLYEKVHEEIARRTTALQTMQRQDGTWRFCFEGAPLTDCHMIFLLKLLGRDKEIEPFVKRLASLQTNEGTWKLYEDEAGGNLSATIQSYAALLASEKYTKEDANMKRAEMFINERGGVARAHFMTKFLLAIHGEYEYPSLFHLPTPIMFLQNDSPLSIFELSSSARIHLIPMMLCLNKRFRVGKKLLPNLNHIAGGGGEWFREDRSPVFQTLLSDVKKIITYPLSLHHKGYEEVERFMKERIDENGTLYSYATASFYMIYALLALGHSIQSPIIEKAITGITSYIWKMERGSHLQNSPSTIWDTALLSYALQEAQVPKASKVIHNASAYLLRKQQTKKVDWSVHAPDLFPGGWGFSDVNTTIPDIDDTTAALRALARSRGNENVDNAWKRAVNWVKGLQNNDGGWGAFEKGVTSRILANLPIENASDMITDPSTPDITGRVLEFFGTYTQNELPEKQKQSAINWLMNVQEENGSWYGKWGICYIYGTWAVMTGLRSFGIPSSNPSLKRAALWLEHIQHEDGGWGESCQSSVEKRFVTLPFSTPSQTAWALDALISYYDKETPVIRKGISYLLSNSYINEKYPTGTGLPGGFYIRYHSYAHIYPLLTLAHYAKKYKK

SEQ ID NO: 65 - protein, 620 aa, Bacillus thuringiensis
MSNLLLYEKVYEEIARRTTALQTMQRQDGTWRFCFEGAPLTDCHMIFLLKLLGRDKEIEPFVKRLASLQTNEGTWKLYEDEVGGNLSATIQSYAALLASEKYTKEDANMKRAEMFINERGGVARAHFMTKFLLAIHGEYEYPSLFHLPTPIMFLQNDSPLSIFELSSSARIHLIPMMLCLNKRFRVGKKLLPNLNHIAGGGGEWFREDRSPVFQTLVSDVKKIITYPLSLHHKGYEEVERFMKGRIDENGTLYSYATASFYMIYALLALGHSIQSPIIEKAIMGITSYIWKMERGSHLQNSPSTIWDTALLSYALQEAQVPKVSKVIQNASAYLLRKQQTKKVDWSVHAPDLFPGGWGFSDVNTTIPDIDDTTAVLRALARSRGNENVDNAWKRAVNWVKGLQNNDGGWGAFEKGVTSRILANLPIENASDMITDPSTPDITGRVLEFFGTYTQNELPEKQKQSAINWLMNVQEENGSWYGKWGICYIYGTWAVLTGLRSLGIPSSDSSLKRAVLWLEHIQHEDGGWGESCQSSVEKRFVTLPFSTPSQTAWALDALISYYDKETPVIRKGISYLLSNPYINEKYPTGTGLPGGFYIRYHSYAHIYPLLTLAHYAKKYRK

SEQ ID NO: 66 - protein, 620 aa, Bacillus thuringiensis
MSNLLLYEKVHEEIARRTTALQTMQRQDGTWQFCFEGAPLTDCHMIFLLKLLGRDKEIEPFVKRLASLQTNEGTWKLYEDEMGGNLSATIQSYAALLASEKYTKEDANMKRAENFIKERGGVARAHFMTKFLLAIHGEYEYPSLFHLPTPIMFLQNDSPLSIFELSSSARIHLIPMMLCLNKRFRVGKKLLPNLNHIAGGGGEWFREDRSPVFQTLASDVKKIITYPLSLHHKGYEEVERFMKERIDENGTLYSYATASFYMIYALLALGHSIQSPIIEKAIMGITSYIWKMERGSHLQNSPSTIWDTALLSYALQEAQVPKASKVIQNASAYLLRKQQTKKVDWSVHAPDLFPGGWGFSDVNTTIPDIDDTTAVLRALARSRGNENVDNAWKRAVNWVKGLQNNDGGWGAFEKGVTSRILANLPIENASDMITDPSTPDITGRVLEFFGTYGQNELPEKQKQSAINWLTNAQEENGSWYGKWGICYIYGTWAVLTGLRSLGIPSSDPSLKRAALWLEHIQHEDGGWGESCHSSVEKRFVTLPFSTPSQTAWALDALISYYDKETPVIRKGISYLLSNPYINEKYPTGTGLPGGFYICYHSYAHIYPLLTLAHYAKKYRK

SEQ ID NO: 67 - protein, 620 aa, Bacillus thuringiensis
MSNLLLYEKVHEEIARRTTALQTMQRQDGTWRFCFEGAPLTDCHMIFLLKLLGRDKEIEPFVKRLASLQTNEGTWKLYEDEVGGNLSATIQSYAALLASEKYTKEDANMKRAEMFINERGGVARAHFMTKFLLAIHGEYEYPSLFHLPTPIMFLQNDSPLSIFELSSSARIHLIPMMLCLNKRFRVGKKLLPNLNHIAGGGGEWFREDRSPVFQTLLSEVKKIITYPLSLHHKGYEEVERFMKERIDENGTLYSYATASFYMIYALLALGHSIQSPIIQKAITGIASYIWKMERGSHLQNSPSTVWDTALLSYALQEAQVPKASKVIQNASAYLLRKQQTKKVDWSVHAPNLFPGGWGFSDVNTMIPDIDDTTAVLRALARSRGDENVDNAWKRAVNWVKGLQNNDGGWGAFEKGVTSRILANLPIENASDMITDPSTPDITGRVLEFFGTYAQNELPEKQKQSAINWLMNVQEENGSWYGKWGICYIYGTWAVLTGLRSLGIPSSDPSLKRAALWLEHIQHEDGGWGESCQSSVEKRFVTLPFSTPSQTAWALDALISYYEKETPIIRKGISYLLSNPYVNEKYPTGTGLPGGFYIRYHSYAHIYPLLTLAHYTKKYRK

SEQ ID NO: 68 - protein, 617 aa, Bacillus thuringiensis
MLLYEKVHEEIARRTTALQTMQRQDGTWRFCFEGAPLTDCHMIFLLKLLGKDKEIEPFVKRLASLQTNEGTWKLYEDEVGGNLSATIQSYAALLASEKYTKEDVNMKRAEMFINEHGGVARAHFMTKFLLAIHGEYEYPSLFHLPTPIMFLQNDSPLSIFELSSSARIHLIPMMLCLNKRFRVGKKLLPNLNHIAGGGGEWFREDRSPVFQTLVSDVKKIITYPLSLHHKGYEEVERFMKERIDENGTLYSYATASFYMIYALLALGHSIQSPIIQKAITGITSYIWKMERGSHLQNSPSTVWDTALLSYALQEAQVPKASKVIHNASAYLLRKQQTKKVDWSVHAPDLFPGGWGFSDVNTTIPDIDDTTAALRALARSRGNENVDTAWKRAVNWVKGLQNNDGGWGAFEKGVTSRILANLPIENASDMITDPSTPDITGRVLEFFGTYTQNELPEKQKQSAINWLMNVQEENGSWYGKWGICYIYGTWAVLTGLRSLGIPSSDPSVKRAALWLEHIQHEDGGWGESCQSSVEKRFVTLPFSTPSQTAWALDALISYYDKETPVIRKGISYLLSNSYINEKYPTGTGLPGGFYIRYHSYAHIYPLLTLAHYAKKYRK

SEQ ID NO: 69 - protein, 617 aa, Bacillus thuringiensis
MLLYEKVHEEIARRTTALQTMQRQDGTWRFCFEGAPLTDCHMIFLLKLLGRDKEIEPFVKRLASLQTNEGTWKLYEDEVGGNLSATIQSYAALLASEKYTKEDANMKRAEMFINERGGVARAHFMTKFLLAVHGEYEYPSLFHLPTPIMFLQNDSPLSIFELSSSARIHLIPMMLCLNKRFRVGKKLLPNLNHIAGGGGEWFREDRSPVFQTLLSEVKKIITYPLSLHHKGYEAVERFMKERIDENGTLYSYATASFYMIYALLALGHSIQSPIIQKAITGITSYIWKMERGSHLQNSPSTVWDTALLSYALQEAQVPKASKGIQNASAYLLRKQQTKKVDWSVHAPDLFPGGWGFSDVNTTIPDIDDTTAVLRALARSRGNENVDNSWKRAVNWVKGLQNNDGGWGAFEKGVTSRILANLPIENASDMIPDPSTPDITGRVLEFFGTYAQNELPEKQKQSAINWLMNIQEENGSWYGKWGICYIYGTWAVLTGLRSLGIPSSDPSLKRAALWLEHIQHEDGGWGESCQSSVEKRFVTLPFSTPSQTAWALDALISYYEKETPVIRKGISYLLSNPYVNEKYPTGTGLPGGFYIRYHSYTHIYPLLTLAHYAKKYRK

SEQ ID NO: 70 - protein, 617 aa, Bacillus weihenstephanensis
MLLYDKVHEEIERRTTALQTMQRQDGTWQFCFEGALLTDCHMIFLLKLLGRNDEIEPFVKRLVSLQTNEGTWKLYEDEKGGNLSATIQAYAALLASEKYSKEDMNMRRAEMFIKEHGGVSRAHFMTKFLLAIHGEYEFPALFHFPTPILFLQDDSPLSIFGLSSSARIHLIPMMICMNKRFRVEKKLLPNLNHIAGGGGQWFREERSPLIQSFLGDVKKVISYPLSLHHKGYEEVERFMKERIDENGTLYSYASATFYMIYALLALGHSIQSPIIEKAVTGLKSYIWKMDRGSHLQNSPSTVWDTALLSYSLQEAKVTNENKMIQRATEYLLQKQQTKKVDWSVHASSLVAGGWGFSDVNTTIPDIDDTTAALRALARSRGNDRVDDAWGRGVEWVKGLQNNDGGWGAFERGVTSKLLSNLPIENASDMITDPSTPDITGRVLELFGTYAPNELLEEQKKKAIKWLMDVQEQNGSWYGKWGICYIYGTWATMTGLRALGVPSTHPALKKAASWLEHLQHEDGGWGESCQSSVEKKFISLPFSTPSQTAWALDALISYYDQETPIIRKGISYLLAQSTMNEKYPTGTGLPGGFYIRYHSYGHIYPLLALAHYVKKYRK

SEQ ID NO: 71 - protein, 698 aa, Bacterium Ellin514
MIKNFTALWPIRRVKGVSVTSQDGHSANGASKPDFEVRPHVDLETAIHRSQSFLLKEQKPEGYWVGELIVDSTLVSDTIAYHHWNGKVDMEWQRKAVNHIFSMQLPDGGWNIYYGGPAEINATVKAYLALKLAGVPVMDPRMLRARSVALSMGGVPRMNTFSKLYLALLGLFPWNYVPTIPCEVILIGKWFHVNFYEMSSWSRSMLVPLAIINHFKPTRKLQNQVKLDELYPEGYHERDLALPPDPEFLTFRNFFLWLDKLHKFAELWVQAGIHPFRRRALKKCEHWMLERFEGSNGLAAIFPAMLNSLIALKALGYPGDHPEVKRAEKELKNLEHETADTVRIEPCFSPVWDTAIVAICLHESGIPSDHPALKKSAEWLIDKEIRFRGDWYFKNPVDVEPSGWVFEFENKWNPDVDDTAMVLLALRKIPTSDVKRRDECFQRGLKWMMAFQCKDGGWAAFDKDCTKGILEKVPFADHNAMLDPECADITARILELLGYEGVGVDHPQIKKALQFIQEEQEDDGSWYGRWGVNYIYGTWQVLRGLRALNINMNQPWLLKARDWLESVQHEDGGWGERCNTYDDPVFKGQGPSTASQTAWAVMGLCTFDDPQRPSLMRGIDYLIKTQNSDGSWTEHEITGTGFPRVFYLKYDMYRNSWPLLALATYRNLYASSEKTANGHTNGHSVQLPEALKTPPAFK

SEQ ID NO: 72 - protein, 651 aa, Bacterium Ellin514
MKSEEVTIKPAVGLEKDELNAAITRSQSFLLCEQKPEGYWVGELMVDSTIVSDTIAYHHWNGKVDPEWQRKAVNHILSMQLPEGGWNIYQNGPPEVNATIKAYLALKLAGIPITDPRMLKARQVALTLGGVPRMNTFSKLYLALLGLWPWKYVPTIPCEVLLLGKWFHVNIWDMSNWSRAMIVPLAIINHYKPTRPVKVDLSELFLEGFHERDLALPKDPQSFTWRNFFLGLDQLHKFAELWVNAGIHPFRRLALKKCEQWMLERFEGSDGLAAIFPAMLNSLIALKSLGYPDDHPEVLRAERELKKLEHETKDTVRIEPCLSPGWDTAIAAMCLRESGVPAEHPRLKKAGDWLVNREVRFKADWHHKNPVDVEPSGWVFQFNNKWNPDLDDTAMVLLALRLIPTDHPRRRDEAFQRGLKWLLAFQCRDGGWAAYDKDCTKNILEKVPFADHNAMLDPECADITARVLELLGFEGYALDHPQVQEAVEYLREHQETDGSWYGRWGVNYIYGTWQTLRGLWALKMDMNQPWLLKARDWLESVQLPDGGWGERCNTYDDPVFKGQGPSTASQTAWAVMALCTFGDPKRPSLVRGIQYLIENQNEDGSWTELETTGTGFPRVYYLKYDIYRNTWPLLAMATYRKMLDPKEVRVK

SEQ ID NO: 73 - protein, 662 aa, Beijerinckia indica
MPEEAILTETHPLDATTIETAITRARKALLGEQRADGHFVFELEADVSIPCEYILFYHFIGRPAPAELEAKIGHYLRARQSAEHDGWPLFQDGAFNISSSVKAYFALKAIGDTPDMPHMQRARTAILAHGGAAAANVFTRSLLALFGLIPWHGIPVMPIEIMHLPEWFPFHIAKISYWGRTVLVPMMVVHALKPKPANTCTIRIDELFVIPPDQVRHWPGSPGKRFPWTAIFAGIDKVLQIAEPYFPRRSRQSAIDKAVAFVTKRLNGEDGLGAIYPAMAYSALMYLSIGRSLSDPHIQLVLKAIDKLVVVKDHEAYVQPCVSPVWDTALASHALMEAGDGDKPILDSLKKGLAWLKPLQVTDIAGDWAWKKPDVKPGGWAFQYGNAYYPDLDDTAVVVMAMDRARDRWPEIDEDNFRPSIARAREWIVGLQSENGGFGAFDADNDRDYLNAIPFADHGALLDPPTADVTARCISMLTQLGEKPENSETLRRAIAYLFAEQEKDGSWFGRWGLNYIYGTWSVLCSLNAAGIAHDAPEVRRAVAWLRTIQNEDGGWGEDAESYALDYAGYQQAPSTSSQTAWAVLGLMAAGEKDDPAVARGIAYLTRTQGEDGFWTEKRFTATGFPRVFYLRYHGYSKFFPLWAMARYRNLHNGNHASVLTGM

SEQ ID NO: 74 - protein, 691 aa, Blastopirellula marina
MEGASPTASNRISQYAVDLRAKARAAVASTCDWLLSHQHADGHWCAELEGDSILQSEYILLLAWLGKERTEIARRCAAHLLKQQEPNGAWTQFPGAPIDVGSSVKAYFALKLTGHDAAADYMVRARNAILEAGGADKVNSFTRFYLALLGQIPFELCPAVPPEMVLLPNWSPINIYRISSWSRTIFVPLSIVWAHRAARDIVEDVSIHELFIRKPEDWPELRCPGLEKPAGLFSWDRFFRTADSGLKLLEKYGLRPLRKRALRQAQQWMLDRFQQSDGPGAIFPPIVWSAIALRTLGYAEDSPEIQYCLDHLERLVLEDGETTKLQPCKSPVWDTSITLRALAAAGLGLAQEPTCRGVEWLLSKEVRVPGDWTNNVDCEPGGWFFEYENAFYPDNDDTSMGIMALADQLAAANITLEVHPGETLANTSVVVGGRGIAEQLAGSSAAMMEQAAAATRRAVAWMVAMQNKDGGWGAFDKNNDAEFLCHVPFADHNAMIDPSTPDLSARVIESFGRLGVTIESPGKLGDTVRRAVAYIRANQLSDGSWFGRWGVNYIYGTWQCLVGLRAVGVPANDPAIEQGKLWLLAHQQACGGWGESCETYEDPSLRGQGSPTASQTAWALLGIIAAGGANLAEVVHGVQYLMDTQREDGAWDEIEFTGTGFPRVFYLKYHYYPIYFPLLALAEWNRATARS

SEQ ID NO: 75 - protein, 610 aa, Blastopirellula marina
MDQDRLQRCYAIARDDLLAQRNGQGHWTGELSTSALSTATAVSALQLVVRHDPAQSERLMPLIEGGVRYLTEHQNPDGGWGDTDRSYSNIATTMLAVAALTIAERREALFEQLAFAENYIEAQGGIPGLRRRYGKDKTFAVPILTNYALAGLVDWREVSPLPFELACLPQKFYKLVKLPVVSYAIPALVAIGQARYFHRPPFNPLMRGLRGAAVKKSLAVLERMQPASGGYLEAAPLTSFVVMSLASIGNASHPVAQNGVQFLVDSVREDGSWPIDSNLANWVTTLSISALATGGDDIAELDCLPWVLANQYQETHPFTGADPGGWGWTDLSGSVPDADDTPGAMLAIAHFFHSPRADNETRRQIASAAISGARWLLDLQNSDGGWPTFCAGWGTQPFDRSGSDLTAHAIRALHAWRSELGDLPVERAIERGLRYLQKQQRDDGSWLPLWFGNQDIHDDENPIYGTVKVLLAYRDLGKMSSETAQRGAAWLAARQNEDGGFGGGPSISTLCGGPGESSVEETALAIEALFAAENSNISAEIVPPAVGWLCQRVEEGSYVNCTPIGFYFSKLWYYEKLYPRVMTVTSLGAALQANASVPPAPETVTTSSDH

SEQ ID NO: 76 - protein, 660 aa, Bradyrhizobium japonicum
MDSVNATAREAKESKISESEILESSIASATQGVLGFQQSDGHWVFELEADCTIPAEYVLLRHYLAEPVDTVLEAKIGNYLRRVQGAHGGWPLVHDGEFDMSASVKAYFALKMIGDSIDAPHMVRAREAIHARGGAIHSNVFTRFMLAMFGIVTWRAVPVLPIEIMLLPFWSPFHINKISYWARTTMVPLMVIAALKPRAKNPKGVGIDELFLQDPRSIGMTAKAPHQSMAWFLLFRSLDAILRVIEPLFPKSLRKRAIDTALAFSEERLNGEDGMGAIYPPMANLVMMYDALGKDENYPPRAVTRRGIDKLLVIGDDEAYCQPCVSPVWDTTLTAHALLEAGGDKAGPAAKHGLDWLIPKQELEVKGDWAVKRPDVRPGGWAFQYNNAYYPDLDDTAVVVMSMDRMRREHGVTGYDSAIDRGREWIEGMQSDDGGWAAFDVNNLEYYLNNIPFSDHGALLDPPTEDVTARCVSMLAQLGETAKTSKHVADGVAYLRKTQHPEGSWYGRWGMNFIYGTWSVLCALNMAGVRHDDPMIRKAADWLASIQNKDGGWGEDTVSYRLDYKGWEAAPSTASQTAWALLALMAAGEVDHPAVARGVEYLIATQNEKGLWDEQRYTATGFPRVFYLRYHGYSKFFPLWGLARYRNLRNTNSRVVGVGM

SEQ ID NO: 77 - protein, 656 aa, Acetobacter pasteurianus
MAADGSALSESRLSSEALDRAVLSAHTALSQAQQDDGHWVYELEADATIPAEYILLEHFMDRIDDALEQKIAIYLRRIQSEEHGGWPLYHNGKFDLSATVKAYFALKAVGDDINAPHMQRAREAILDHGGAERSNVFTRSQLALFGEVPWRATPVMPVELMLLPAKAFFSVWNMSYWSRTVIAPLLVLAALRPVAANPRQVHVRELFVTPPEKVQDWIRGPYRSAWGYVFKGLDSVLRPVVPFIPEKTHKKAIQAALDFIEPRLNGKDGLGAIYPAMANVVMMYRAMGVPDEDPRAKTAWEAVQALIVEKDDEAYCQPCVSPIWDTGLSGHAMIEAASGPNGIAPEKTVAELKKASAWLRSKQILNVKGDWAVRNPNLAPGGWAFQYGNDYYPDVDDTAVVGMLLHREGDPTNAEAIERARTWIVGMQSTDGGWGAFDIDNNKDVLNHIPFADHGALLDPPTADVTARCISFLAQLRNPEDEPVIQRGLEYLRKEQEKDGSWFGRWGTNYIYGTWSALCALNAAGVSHDDPAVVKAVEWLRSVQRADGGWGEGCESYEGGPHGTYGESLPSQTAWAVLGLMAAGRRDDPAVTRGIAWLADQQDANGEWHEDPYNAVGFPKVFYLRYHGYKQFFPLMALARYRNLESSNTRRVSFGF

SEQ ID NO: 78 - protein, 684 aa, Bradyrhizobium sp.
MTLTSSASARAPRDPGNYQTALQSTVRAAADWLIANQKPDGHWVGRAESNACMEAQWCLALWFMGLEDHPLRKRLGQSLLDTQRPDGAWQVYFNAPNGDINATVEAYAALRSLGYPDSEPAVRRAREWIEAKGGLRNIRVFTRYWLALIGEWPWEKTPNIPPEVIWFPLWFPFSIYNFAQWARATLMPIALLSARRPSRPLPPENRLDTLFPRGRDAFDYELPVKANAGGWDKFFRGADKVLHALQNFGNRLNLGLFRPAATSRVLEWMIRHQDFDGAWGGIQPPWIYGLMALYAEGYPLNHPVLAKGLDALNDPGWRVDVGEATYIQATNSPVWDTILTLLAFDDAGVLGDYPDAVDKAVNWVLARQVRVPGDWSMKLPHVKPGGWAFEYANNHYPDTDDTAVALIALAPLRHDPKWKAKGIDEAIQLGVDWLIGMQSQGGGWGAFDKDNNQQILTKIPFCDYGEALDPPSVDVTAHIVEAFGKLGISRNHPSMVQALDYIRKEQEPSGPWFGRWGVNYVYGTGAVLPALAAIGEDMTQPYIGRACDWLVAHQQPDGGWGESCASYMDISAVGRGTTTASQTAWALMALLAANRPQDKDAIERGCMWLVERQSAGTWDEPEFTGTGFPGYGVGQTIKLTDPSLQERLMQGPELSRAFMLRYGMYRHYFPLMALGRALRPQGHG

SEQ ID NO: 79 - protein, 660 aa, Brevibacillus brevis
MRIGTTTNPSMPFPLSSSGAVFYREVNELREVQQEINRIQAFLLQRQQEDGTWRFCLESSPMTDSHMIILLRTLGIHDERLMEKLTAHITALQHDNGAWKLYPDEQEGHLSTTIDSYYALLLSGKYTKNEPRMALARSFILEKGGLTQANMLTKFATALTGQYQWPSHFLVPVEIALLPPSFPVSFYDFVGYARVHLAPMMIVADRNYVKKPDNAPDLSDLYADTPISRGLYPHRFLENFLKEGQSFLATIHDSLQQLPFLPGQLHKLALRRLEQYILARIEPDGTLYNYSTSTFFMIFALLARGFSPKDPLIQKAMQGLTGSVYDYENGAHLQLATSAVWDTALLTFSLQKSGLSPTHPAIQKANRYLLRKQQHTYGDWKIRNPNGKPGGWGFSDYNTMNPDIDDTTAALRSLRLLARTDVTAATAWKRGLEWLLSMQNDDGGWPAFERNTDADFIRHLPIEGADTVSTDPSSADLTGRTLEFLGNYAGRTLTDLHVEKGVRWLLKHQESDGSWYGRWGIAYLYGTWAAITGLMAVGFSPTEPAIQKAVAWLVANQNPDGGWGESCQSDLKKTYVPLGASTPSQTAWAIDALIAVSSKPTAELQRGIRYLLTHNQANDWTTRYPTGGGRPGGTYFAYHSYRWIWPLLALSHYQVKYANT

SEQ ID NO: 80 - protein, 682 aa, Burkholderia ambifaria
MIRRMNKPAPSPWSALDTAIARGRDALMRLQQPDGSWCFELESDATITAEYILMMHFMDKIDDARQEKMARYLRAIQRLDTHGGWDLYLDGDPDLSCSVKAYFALKAAGDSEHAPHMVRARDAILKLGGAARSNVFTRILLATFGQVPWRATPFMPIEFVLFPKWVPISMYKVAYWARTTMVPLLVLCSLKARARNPRNIAIPELFVTPPDQERQYFPPARGMRRAFLALDRVVRHVEPLLPKRLRQRAIRHAQAWCAERMNGEDGLGGIFPPIVYSYQMMDVLGYPDDHPLRRDCENALEKLLVTRPDGSMYCQPCLSPVWDTAWSTMALEQARGVAVPEAGAPAGALDELDARIARAYDWLAERQVNDLRGDWIENAPADTQPGGWAFQYANPYYPDIDDSAVITAMLDRRGRTHRNADGSHPYAARVARALDWMRGLQSRNGGFAAFDADCDRMYLNAIPFADHGALLDPPTEDVSGRVLLCFGVTKRADDRASLARAIDYVKRTQQPDGSWWGRWGTNYLYGTWSVLAGLALAGEDPSQPYIARALAWLRARQHADGGWGETNDSYIDPALAGTNAGESTSNCTAWALLAQMAFGDGESESVKRGIAYLQSVQQDDGFWWHRSHNAPGFPRIFYLKYHGYTAYFPLWALARYRRLAGGASSAGAHTVPASTGADAALA

SEQ ID NO: 81 - protein, 682 aa, Burkholderia ambifaria
MIRRMNKPAPSPWSALDAAIARGRDALMRLQQPDGSWCFELESDATITAEYILMMHFMDKIDDARQEKMARYLRAIQRLDTHGGWDLYVDGDPDVSCSVKAYFALKAAGDSEHAPHMVRARDAILALGGAARSNVFTRILLATFGQVPWRAAPFMPIEFVLFPKWVPISMYKVAYWTRTTMVPLLVLCSLKAHARNPRNIAIPELFVTPPDQERHYFPPARGMRRAFLALDRVVRHAEPLLPKRLRQRAIRHAQAWCAERMNGEDGLGGIFPPIVYSYQMMDVLGYPADHPLRRDCENALEKLLVTRPDGSMYCQPCLSPVWDTAWSTMALEQARGVAVHEAGAPASALDELDARIARAYDWLAERQVNDLRGDWIENAPADTQPGGWAFQYANPYYPDIDDSAVVTAMLDRRGRTHRNADGTHPYAARVARALDWMRGLQSRNGGFAAFDADCDRMYLNAIPFADHGALLDPPTEDVSGRVLLCFGVTKRADDRASLARAIDYVKRTQQPDGSWWGRWGTNYLYGTWSVLAGLALAGEDPSQPYIARALAWLRARQHADGGWGETNDSYIDPALAGTNAGESTSNCTAWALLAQMAFGDGESESVKRGIAYLQSVQQDDGFWWHRSHNAPGFTRIFYLKYHGYTAYFPLWALARYRRLAGGASSAGAHAVPASTAADAALA

SEQ ID NO: 82 - protein, 678 aa, Burkholderia ambifaria
MNKPAPSPWSALDTAIARGRDALMRLQQPDGSWCFELESDATITAEYILMMHFMDKIDDVRQEKMARYLRAIQRLDTHGGWDLYVDGDPDVSCSVKAYFALKAAGDSEHAPHMVRARDAILALGGAARSNVFTRILLATFGQVPWRATPFMPIEFVLFPKWVPISMYKVAYWARTTMVPLLVLCSLKARARNPRNIAIPELFVTPPDEERHYFPPARGMRRAFLALDRVVRHVEPLLPKRLRQRAIRHAQAWCAERMNGEDGLGGIFPPIVYSYQMMDVLGYPDDHPRRRDCENALEKLLVTRTDGSMYCQPCLSPVWDTAWSTMALEQARAVAVPEAGARASALDELDARIARAYDWLAERQVNDLRGDWIENAPADTQPGGWAFQYANPYYPDIDDTAVVTAMLDRRGRTHRNADGSHPYAARVARALDWMRGLQSRNGGFAAFDADCDRMYLNAIPFADHGALLDPPTEDVSGRVLLCFGVTKRAADRASLARAIDYVKRTQQPDGSWWGRWGTNYLYGTWSVLAGLALAGEDPSQPYIARALAWLRARQHADGGWGETNDSYIDPTLAGTNAGESTSNCTAWALLAQMAFGDCESESVRRGIAYLQSVQQDDGFWWHRSHNAPGFPRIFYLKYHGYTAYFPLWALARYRRLASGVSSAGVHAVPASTGADAALA

SEQ ID NO: 83 - protein, 657 aa, Burkholderia ambifaria
MNDLTEMATLSAGTVPAGLDAAVASATDALLAAQNADGHWVYELEADSTIPAEYVLLVHYLGETPNLELEQKIGRYLRRVQQADGGWPLFTDGAPNISASVKAYFALKVIGDDENAEHMQRARRAIHAMGGAEMSNVFTRIQLALYGAIPWRAVPMMPVEIMLLPQWFPFHLSKVSYWARTVIVPLLVLNAKRPIAKNPRGVRIDELFVDPPVNAGLLPRQGHQSPGWFAFFRVVDHVLRAADGLFPSYTRERAIRQAVSFVDERLNGEDGLGAIYPAMANAVMMYDVLGYAEDHPNRAIARKSIEKLLVVHEDEAYCQPCLSPVWDTSLAAHALLETGDARAEEAVIRGLEWLRPLQILDVRGDWISRRPHVRPGGWAFQYANAHYPDVDDTAVVAVAMDRVQKLKHNDTFRDSIALAREWVVGMQSSDGGWGAFEPENTQYYLNNIPFSDHGALLDPPTADVSGRCLSMLAQLGETPLNSEPARRALDYMLKEQEPDGSWYGRWGMNYVYGTWTALCALNAAGLTPDDPRVKRGAQWLLSIQNKDGGWGEDGDSYKLNYRGFEQAPSTASQTAWALLGLMAAGEVNNPAVARGVEYLIAEQKEHGLWDETRFTATGFPRVFYLRYHGYRKFFPLWALARYRNLKRDNATHVTFGL

SEQ ID NO: 84 - protein, 687 aa, Burkholderia cenocepacia
MIRRMNQSAPSSWSALDAAIARGRDALVRLQQPDGSWCFELESDATITAEYILMMHFMDRIDDVRQEKMARYLRANQRLDTHGAWDLYVDGAPDVSCSVKAYFALKAAGDSEHAPHMIRARDAILKLGGAARSNVFTRILLATFGQVPWRAAPFMAVEFVLFPKWVPISMYKVAYWARTTMVPLLVLCSLKARARNPRNVSIRELFVTPPEQERHYFPPARGMRRLFLALDRTVRPIEPLLPKRLRQRAIRHAEAWCAERMNGEDGLGGIFPPIVYSYQMMQVLGYPDDHPLRRDCENALEKLLVTRPDGSMYCQPCLSPVWDTAWSTMALEQARGVAAPETGDTATGAPRDLDGRIARAYDWLATRQVNDLRGDWIENAPADVEPGGWAFQYANPYYPDIDDTALVTAMLDRRGRTHRAADGTHPYASCVSRALDWMRGLQSRNGGFAAFDADCDRMYLNAIPFADHGALLDPPTEDVSGRVLLCFGVTKRAADRASLARAIDYVKRTQQPDGSWWGRWGTNYLYGTWSVLAGLALAGEDKSQPYIARALDWLRARQHADGGWGETNDSYLDPKLAGTNGGESTSNCTAWALLAQMAFGDCESDSVKRGIAYLQSVQQEDGFWWHRSHNAPGFPRIFYLKYHGYTAYFPLWALARYRRLAGAKDAGATRSGASGASATSVTDDALA

SEQ ID NO: 85 - protein, 684 aa, Burkholderia cenocepacia
MIRRMNKSAPSPWSALDAAIARGRDALVRLQQPDGSWCFELESDATITAEYILMMHFMDRIDDVRQERMARYLRANQRLDTHGAWDLYVDGAPDVSCSVKAYFALKAAGDSEHAPHMIRARDAILKLGGAARSNVFTRILLATFGQVPWRAAPFMPIEFVLFPKWVPISMYKVAYWARTTMVPLLVLCSLKARARNPRNVSIRELFVTPPEQERHYFLPARGMRRLFLALDRTVRPIEPLLPKRLRQRAIRHAEAWCAERMNGEDGLGGIFPPIVYSYQMMQVLGYPDDHPLRRDCENALEKLLVTRPDGSMYCQPCLSPVWDTAWSTMALEQARGVAAPETGDTASGALRELDERIARAYDWLATRQVNDLRGDWIENAPADVEPGGWAFQYANPYYPDIDDTALVTAMLDRRGRTHRGADGTHPYASRVARALDWMRGLQSRNGGFAAFDADCDRMYLNAIPFADHGALLDPPTEDVSGRVLLCFGVTKRAADRASLAHAIDYVKRTQQPDGSWWGRWGTNYLYGTWSVLAGLALAGEDKSQPYITRALDWLRARQHADGGWGETNDSYIDPKLAGTNDGESTSNCTAWALLAQMAFGDCESDSVKRGIAYLQSVQQEDGFWWHRSHNAPGFPRIFYLKYHGYTAYFPLWALARYRRLAGAKDADATRSPASATPATDNALA

SEQ ID NO: 86 - protein, 679 aa, Burkholderia cenocepacia
MIRRMNKSAPSPWSTLDTAIARGRDALVRLQQPDGSWCFELESDATITAEYILMMHFMDRIDDVRQEKMARYLRANQRLDTHGAWDLYVDGAPDVSCSVKAYFALKAAGDSEQAPHMIRARDAILKLGGAARSNVFTRILLATFGQVPWRAAPFMPIEFVLFPKWVPISMYKVAYWARTTMVPLLVLCSLKARARNPRNVSIRELFVTPPEQERRYFPPARGMRRLFLALDRAVRHIEPLMPKRLRQRAIRHAQAWCAERMNGEDGLGGIFPPIVYSYQMMQVLGYPDDHPLRRDCENALEKLLVTRPDGSVYCQPCLSPVWDTAWSTMALEQARGVAAPETGETAAGTLRELDERIARAYDWLAARQVNDLRGDWIENVPADVEPGGWAFQYANPYYPDIDDSALVTAMLDRRGRTHRHADGTNPYAPRVARALDWMRGLQSRNGGFAAFDADCDRMYLNAIPFADHGALLDPPTEDVSGRVLLCFGVTKRAEDRASLARCIDYVKRTQQPDGSWWGRWGTNYLYGTWSVLAGLALAGEDKSQPYIARALDWLRARQHADGGWGETNDSYLDPTLAGTNGGESTSNCTAWALLAQMAFGDCESDSVKRGIAYLQSVQQEDGFWWHRSHNAPGFPRIFYLKYHGYTAYFPLWALARYRRLAGAAAAPPAALVAADTALA

SEQ ID NO: 87 - protein, 657 aa, Burkholderia cenocepacia
MNDLTEMATLSAGAVPAGVDAAVARATDALLAAQQADGHWVYELEADSTIPAEYVLLVHYLGETPNLELEQKIGKYLRRIQQADGGWPLFTDGAPNISASVKAYFALKVIGDDENAEHMQRARRAIHAMGGAEMSNVFTRIQLALYGAIPWRAVPMMPVEIMLLPQWFPFHLSKVSYWARTVIVPLLVLNAKRPLAKNPRGVRIDELFIDPPVNAGLLPRQGHQSPGWFAFFRVVDHALRAVDGLFPSYTRERAIRQAVSFVDERLNGEDGLGAIYPAMANSVMMYAALGYAEDHPNRAIARKSVEKLLVVHDDEAYCQPCLSPVWDTSLAAHALLETGDARAQEAVLRGLEWLRPLQILDVRGDWISRRPNVRPGGWAFQYANAHYPDVDDTAVVVMAMDRAQKLTQSDTYRESMARAREWVVGMQSSDGGWGAFEPENTQYYLNNIPFSDHGALLDPPTADVSGRCLSMLSQLGETPLNSEPARRALDYMLKEQEPDGSWYGRWGMNYVYGTWTALCSLNAAGLTPDDPRMKRGAQWLLSIQNKDGGWGEDGDSYKLNYRGYEQAPSTASQTAWALLGLMAAGEVNNPAVARGVDYLVAQQNEEGLWDETRFTATGFPRVFYLRYHGYRKFFPLWALARYRNLKRANATRVTVGM

SEQ ID NO: 88 - protein, 658 aa, Burkholderia dolosa
MNDLTDMATLSAGAAPAADLDAAVARATDALLAAQNADGHWVYELEADSTIPAEYVLLVHYLGETPNLELERKIGRYLRRIQQADGGWPLFTDGAPNVSASVKAYFALKVIGDDENAEHMQRARRAIHAMGGAEMSNVFTRIQLALYGAIPWRAVPMMPVEIMLLPQWFPFHLSKVSYWARTVIVPLLVLNAKRPLAKNPRGVRIDELFIDPPVNAGLLPRQGHQSAGWFAFFRVVDHVLRAVDGLFPKYTRERAIRQAVSFVDERLNGEDGLGAIYPAMANAVMMYDVLGYAEDHPNRAIARKSIEKLLVVHDDEAYCQPCLSPVWDTSLAAHALLETGDPRAEDAALRGLEWLRPLQILDVRGDWISRRPNVRPGGWAFQYANAHYPDVDDTAVVAMAMDRAQKLRQSDTYRESIARAREWVVGMQSSDGGWGAFEPENTQYYLNNIPFSDHGALLDPPTADVSGRCLSMLSQLGESALTSEPARRALDYMLKEQEPDGSWYGRWGMNYVYGTWTALCALNAAGLGPDDPRVKRAAQWLLSIQNKDGGWGEDGDSYKLNYRGYEQAPSTASQTAWALLGLMAAGEVNNPAVARGIDYLLAEQKEHGLWDEVRFTATGFPRVFYLRYHGYRKFFPLWALARYRNLKRANATRVTVGM

SEQ ID NO: 89 - protein, 776 aa, Burkholderia glumae
MNDLTNSSAPGARPDDATPSAAGPTPAEAAGGAVAPSRAVQPADTQTAATGAAGAAAAVGATPAELAATAPASSGTPAGASAAPAPSGTPSVDAPAELASAAPAPSGATPAATATAATAPAPARAASIDAPALAAADLDAAITRATDALLAAQQADGHWIYELEADSTIPAEYVLLVHYLGETPNLELERKIARYLRRVQLPGGGWPLFTDGAPDVSASVKAYFALKMIGDDANAEHMVRARNAIHAMGGAEMSNVFTRIQLALFGVVPWFAVPMMPVEIMLLPQWFPFHLSKVSYWARTVTVPLLVLSAKRPLARNPRGVRVDELFVAPPVNAGLLPRAGHQSPAWFACFRLLDGLLRLTDGLFPRYTRERAIRQALQFVDERLNGEDGLGAIYPAMANSVMMYAALGYPEDHPNRATARRAIEKLLVIHDDEAYCQPCLSPVWDTSLAAHALLETGEPRAEAAAIRGLDWLRPLQILDVRGDWISRRPDVRPGGWAFQYANPHYPDVDDTAVVTLAMDRVAKLAQTDAYRDAIARAREWVVGMQSSDGGWGAFEPENTHQYLNSIPFSDHGALLDPPTADVSGRCLSMLAQLGETAANSAPARRALDYLLAEQGADGSWYGRWGMNYIYGTWSALGALNAAGLPFDDPRVKRAAQWLLSIQNPDGGWGEDGDSYKLDYRGYERAASTASQTAWALLGLMAAGEVEHPAVARGIAWLAAQQREHGLWDEARFTATGFPRVFYLRYHGYRKFFPLWALARYRNLRRTGTRRVTVGM

SEQ ID NO: 90 - protein, 676 aa, Burkholderia glumae
MIRPMKNSDLPLPSLLDAAILRGRDALAQRQSADGSWCFELESDATITAEYILMMHFMGKIDEARQARMARYLRGIQRLATHGAWDLYVDGAPDVSCSVKAYFALKAAGDSEDAPHMARARETILKLGGAAKSNVFTRILLATFGQVPWRATPFMPVEFVLFPKWVPISMYKVAYWARTTMVPLLVLCSLKARAKNPRNVSIRELFVTAPEAERHYFARGGFVRNLFLGIDRALRPLDALIPKALRRRAIRHAEAWCAERMNGEDGMGGIFPPIVYSYQMMDVLGYPEDHPLRRDCENALDKLLVERPDGSVYCQPCLSPVWDTAWSTMALEQARAVPDPRDAPPVSDAQLQRCIAASYEWLAGKQVTQVRGDWVENAPAATPAGGWAFQYENPYYPDIDDSAVVAAMLHRRGRLLARSTGTDPYAQVVARGLDWMRGLQSRNGGFGAFDADCDRLYLNLIPFADHGALLDPPTEDVSGRVLLCLGVTGRDEDKPALARAIEYVKRMQRADGCWWGRWGTNYIYGTWSVLAGLALAGENPSQPYIARAIAWLRACQNADGGWGETNDSYLDPALAGTNGGESASNVTAWALLAQMAFGDWQSESVQRGIRYLLSVQQADGFWWHRSHNAPGFPRIYYLKYHGYTAYFPLWALARYRRLSQAGAARDVTDGAALAAS

SEQ ID NO: 91 - protein, 683 aa, Burkholderia graminis
MNDLSQAHVLGAAMPETAGEAQNAQAAANSAAAAAEASAVLAPSLDAAITRATDAILAAQKPDGHWVYELEADATIPAEYVLLVHYLGETPNVELEQKIARYLRRIQLPNGGWPLFTDGAIDISASVKAYFALKMIGDPVDAEHMVRAREAILAHGGAETVNVFTRILLALFGVVSWRAVPMMPVEITLLPMWFPFHLSKVSYWARTVIVPLLVLNAKRPLARNPRRVRIDELFRGAPVNTGMPARAPHQHVGWFGFFRVVDTVLRAVDGLFPKATRERAVREAVAFVDQRLNGEDGLGAIFPAMANSVMMYDVLGYPADHPNRAIARRSIEKLLVIKDDEAYCQPCLSPVWDTSLAAHALLETGDARAEQAAERGLAWLRPLQILDVRGDWISRRPNVRPGGWAFQYNNAYYPDVDDTAVVAMAMHRSEALTHSGADREAIARAREWVVGMQSSDGGWGAFEPENTQYYLNNIPFSDHGALLDPPTADVSGRCLSMLAQLGEFPQNSEPAQRALDYMLKEQEADGSWYGRWGLNYIYGTWTALCSLNAAGLPHDDPRIRRAAQWLLSIQNEDGGWGEGGESYKLDYRGYERAPSTASQTAWALMGLMAAGEVDHEAVARGIEYLQREQREHGLWDETRFTATGFPRVFYLRYHGYRKFFPLWALARYRHLKRNGLTRVAVGM

SEQ ID NO: 92 - protein, 657 aa, Burkholderia mallei
MNDMTEMHTLDATAAPAGLDAAVARATDALLAAQQADGHWVYELEADSTIPAEYVLLVHYLGEAPNVELEQKIARYLRRIQQPDGGWPLFTDGAPNISASVKAYFALKVIGDDENAEHMQRARRAIHAMGGAEMSNVFTRIQLALYGVVPWYAVPMMPVEIMLLPQWFPFHLSKVSYWARTVIVPLLVLNAKRPVAKNPRGVRIDELFKGAPVSTGLLPKQPHQSAGWFAFFRAVDGVLRLVDGLFPRYTRERAIRQAVAFVDERLNGEDGLGAIYPAMANAVMMYAALGYPEDHPNRAIARRSIEKLLVVGEQEAYCQPCLSPVWDTSLAAHALLETGDARAREAAVRGLDWLVPRQILDVRGDWISRRPHVRPGGWAFQYANAHYPDVDDTAVVAMAMDRVAKLDRTDAYRESIARAREWVVGMQSSDGGWGAFEPENTQYYLNNIPFSDHGALLDPPTADVSGRCLSMLAQFGETSASSEPARRALDYMLKEQEPDGSWYGRWGMNYIYGTWTALCSLNAAGLGHDDPRVKRAAQWLLSIQNADGGWGEDGDSYKLDYRGYERAPSTSSQTAWALLGLMAAGEVDNPAVARGVDYLLGTQREHGLWDETRFTATGFPRVFYLRYHGYRKFFPLWALARYRNLKRANAMRVTVGM

SEQ ID NO: 93 - protein, 683 aa, Burkholderia multivorans
MIRAMNKSALSPWSALDTAIARGRDALARLQQPDGSWCFELESDATITAEYILMMHFMDRIDDALQERMARYLRAIQRLDTHGAWDLYVDGAPDVSCSVKAYFALKAAGDSEHAPHMIRAREAILKLGGAARSNVFTRILLATFGQVPWRATPFMPIEFVLFPKWVPISMYKVAYWARTTMVPLLVLCSLKARARNPRNVAIPELFVTPPDQERHYFPPTRGMRRAFLILDRVVRHVEPLLPKRLRRRAIRHAEAWCAQRMNGEDGLGGIFPPIVYSYQMMDVLGYPEDHPLRRDCENALAKLLVTRPDGSVYCQPCLSPVWDTAWSTMALEQARSVAVPESDESARALDELDARIARAYDWLATRQVNDLRGDWIENAPADTQPGGWAFQYANPYYPDIDDSAVVTAMLDRRGRTHRNADGSHPYAARVARALDWMRALQSRNGGFAAFDADCDRLYLNAIPFADHGALLDPPTEDVSGRVLLCFGVTRRAEDRASLARAIDYVKRTQQPDGSWWGRWGTNYLYGTWSVLAGLTLAGEDPSQPYIARALEWLRAHQHADGGWGETNDSYLDPALAGTNGGESTSNCTAWALLAQMAFGDCASDSVKRGIAYLQSVQQDDGFWWHRSHNAPGFPRIFYLKYHGYTAYFPLWALARYRRLAGAAEARARASSGRAPHAADTALA

SEQ ID NO: 94 - protein, 657 aa, Burkholderia multivorans
MNDLTDMATLSAGTVPAELDAAVARATDALLAAQNADGHWVYELEADSTIPAEYVLLVHYLGETPNLELEQKIGRYLRRIQQADGGWPLFTDGAPNISASVKAYFALKVIGDDENAEHMQRARRAIHAMGGAEMSNVFTRIQLALYGAIPWRAVPMMPVEIMLLPQWFPFHLSKVSYWARTVIVPLLVLNAKRPLAKNPRGVRIDELFIDPPVNAGLLPRQGHQSAGWFAFFRAVDHVLRAVDGLFPAYTRERAIRQAVAFVDERLNGEDGLGAIYPAMANAVMMYDVLGYAEDHPNRAIARKSIEKLLVVHEDEAYCQPCLSPVWDTSLAAHALLETRDPRAEQAAVRGLDWLRPLQILDVRGDWISRRPHVRPGGWAFQYANPHYPDVDDTAVVAMAMDRAQKLNQSDTYRESIARAREWVVGMQSSDGGWGAFEPENTQYYLNNIPFSDHGALLDPPTADVSGRCLSMLSQLGETALNSDAARRALDYMLKEQEPDGSWYGRWGMNYVYGTWTALCALNAAGLGPDDARVKRAAQWLLSIQNKDGGWGEDGDSYKLNYRGYEPAPSTASQTAWALLGLMAAGEVNNPAVKRGIDYLIAEQKEHGLWDEARFTATGFPRVFYLRYHGYRKFFPLWALARYRNLKRDNTTRVTVGI

SEQ ID NO: 95 - protein, 668 aa, Burkholderia oklahomensis
MNDMTEMHTLDAAAAPAADAPAVTAVTAGLDAAVARATDALLAAQNADGHWVYELEADSTIPAEYVLLVHYLGEEPNAELEQKIARYLRRIQQPDGGWPLFTDGAPNVSASVKAYFALKVIGDDENAEHMQRARRAIHAMGGAETSNVFTRIQLALYGVVPWYAVPMMPVEVMLLPQWFPFHLSKVSYWARTVIVPLLVLNAKRPVAKNPRGVRIDELFKSAPVNTGLLPKQPHQSTGWFAFFRAVDGVLRLVDGLFPRYTRERAIRQAVAFVDERLNGEDGLGAIYPAMANAVMMYAALGYPEDHPNRAIARQSIEKLLVVGEEEAYCQPCLSPVWDTSLAAHALLETGDERARDAAVRGLDWLIPRQILDVRGDWISRRPHVRPGGWAFQYANPHYPDVDDTAVVVMAMDRVAKLDQSDAYREQIARAREWVVGMQSSDGGWGAFEPENTQYYLNNIPFSDHGALLDPPTADVSGRCLSMLAQLGETNASSEPARRAFDYMLKEQEPDGSWYGRWGMNYIYGTWTALCALNAAGLGHDDPRVKRAAQWLLSIQNQDGGWGEDGESYKLDYRGYERAPSSSSQTAWALLGLMAAGEVDNPVVARGIDYLLGAQCEHGLWDETRFTATGFPRVFYLRYHGYRKFFPLWALARYRNLKRANTTRVTVGM

SEQ ID NO: 96 - protein, 677 aa, Burkholderia phymatum
MNDLSMTQTLGEVLPQTLIDDHAPVAAALATGAAPVDALDAAVTRATEAILAVQKDDGHWVYELEADATIPAEYVLLVHFLGETPNLELEQKIARYLRRIQLPNGGWPLFTDGAMDVSASVKAYFALKMIGDPEDAAHMVRARECILANGGAEAANVFTRILLALFGVVTWYAVPMMPVEIMLLPKWFPFHLSKVSYWARTVIVPLLVLNAKRPVARNPRGVRIDELFRGAPVTTGLLPRSGHQSKSWFAFFRAVDGVLRVTDGLFPKASRERAIKAAVSFVDERLNGVDGLGAIFPAMANSVMMYDVLGYPADHPNRAIARESIEKLLVVHEDEAYCQPCLSPVWDTSLAAHALLETGDARAEEAAERGLAWLRPLQILDVRGDWISRRPDVRPGGWAFQYNNAHYPDVDDTAVVAMAMHRSAAVTNSNVDANAIARAREWVVGMQSSDGGWGAFEPENTQYYLNNIPFSDHGALLDPPTADVSGRCLSMLAQLGEMPATSEPARRAYDYLLKEQEDDGSWYGRWGMNYIYGTWTALCALNAAGISLEDARIKRAAQWLVSIQNADGGWGEDGTSYKLDYRGYEKAPSIPSQTAWALLGLMAAGYVDHPAVARGIDYLQREQRDHGLWDEERFSATGFPRVFYLRYHGYRKYFPLWALARYRNLKRTGEKRVTVGM

SEQ ID NO: 97 - protein, 676 aa, Burkholderia phytofirmans
MNDLSQAQPLDAILPDFADAAPSAPAPAVTGEAPTASLDAAITRATEAILAAQKPDGHWVYELEADATIPAEYVLLVHYLGETPNLELEQKIARYLRRIQLPDGGWPLFTDGALDISASVKAYFALKMIGDPADAEHMVRAREAILAHGGAETVNVFTRILLALFGVVSWRAVPMMPVEIMLLPMWFPFHLSKVSYWARTVIVPLLVLNAKRPVARNPRRVRIDELFRGAPVNTGPRDRAPHQHAGWFRFFSGVDVLLRAVDGLFPKSTRERAVRQAVAFVDERLNGEDGLGAIFPAMANSVMMYDVLGYPADHPNRAIARQSIDKLLVIKDDEAYCQPCLSPVWDTSLAAHALLETGEAHAEQAAERGLAWLRPLQILDVRGDWISRRPNVRPGGWAFQYNNAHYPDVDDTAVVAMAMQRSATVTQSDVDRDAIARAREWVVGMQSSDGGWGAFEPENTQYYLNNIPFSDHGALLDPPTADVSGRCLSMLAQLGELPQNSEPAQRAFDYMLKEQESDGSWYGRWGLNYIYGTWTALCSLNAAGLPHDDPRMKRAAQWLLSIQNEDGGWGEGGESYKLDYHGYERAPSTASQTAWALMGLMAAGEVNHEAVARGVAYLEREQREHGLWDETRFTATGFPRVFYLRYHGYRKFFPLWALARFRHLKRNGLTRVAVGM

SEQ ID NO: 98 - protein, 657 aa, Burkholderia pseudomallei
MNDMTEMHTLDATAAPAGLDAAVARATDALLAAQQADGHWVYELEADSTIPAEYVLLVHYLGEAPNVELEQKIARYLRRIQQPDGGWPLFTDGAPNISASVKAYFALKVIGDDENAEHMQRARRAIHAMGGAEMSNVFTRIQLALYGVVPWYAVPMMPVEIMLLPQWFPFHLSKVSYWARTVIVPLLVLNAKRPVAKNPRGVRIDELFKGAPVSTGLLPKQPHQSAGWFAFFRAVDGVLRLVDGLFPRYTRERAIRQAVAFVDERLNGEDGLGAIYPAMANAVMMYAALGYPEDHPNRAIARRSIEKLLVVGEQEAYCQPCLSPVWDTSLAAHALLETGDARAREAAVRGLDWLVPRQILDVRGDWISRRPHVRPGGWAFQYANAHYPDVDDTAVVAMAMDRVAKLDRTDAYRESIARAREWVVGMQSSDGGWGAFEPENTQYYLNNIPFSDHGALLDPPTADVSGRCLSMLAQFGETSASSEPARRALDYMLKEQEPDGSWYGRWGMNYIYGTWTALCSLNAAGLGHDDPRVKRAAQWLLSIQNADGGWGEDGDSYKLDYRGYERAPSTSSQTAWALLGLMAAGAVDNPAVARGVDYLLGTQREHSLWDETRFTATGFPRVFYLRYHGYRKFFPLWALARYRNLKRANATRVTVGM

SEQ ID NO: 99 - protein, 681 aa, Burkholderia sp.
MNDLSQTQPLAAVLPEAADAPAVADASATAAPEPVQAASPSALDASITRATDTILAAQKPDGHWVYELEADATIPAEYVLLVHYLGETPNLELEQKIARYLRRIQLPNGGWPLFTDGALDISASVKAYFALKMIGDPVDAEHMVRARDAILAHGGAERANVFTRILLALFGVVSWRAVPMMPVEIMLLPVWFPFHLSKVSYWARTVIVPLLVLNAKRPLARNPRKVRIDELFRAAPVNTGMNERAPHQHAGWFGFFRCVDTVLRAVDGLLPKATRERAIRAAVAFVDERLNGEDGLGAIFPAMANSVMMYDVLGYPADHPHRAIARKSLDKLLVIKDDEAYCQPCLSPVWDTSLAAHALLETGEARAEQAAERGLAWLRPLQILDVRGDWISRRPNVRPGGWAFQYNNAHYPDVDDTAVVAMAMHRSAALTQSDVDREAIARAREWVVGMQSSDGGWGAFEPENTQYYLNNIPFSDHGALLDPPTADVSGRCLSMFAQIGELPQSSEPARRAFDYMLQEQEPDGSWYGRWGLNYIYGTWTALSSLNAAGMPHDDPRMRRAAQWLVSIQNEDGGWGEGGESYKLDYHGYERAPSTASQTAWALLGLMAAGEVNHEAVARGIDYLQREQREHGLWDETRFSATGFPRVFYLRYHGYRKFFPLWALARFRHLKRHGLTRVTVGM

SEQ ID NO: 100 - protein, 678 aa, Burkholderia sp.
MIRRMTTPTPSPWSALDTAIARGRDALVRLQQPDGSWCFELESDATITAEYILMMHFMDKIDDLRQEKMARYLRANQRLDTHGGWALYVDGDPDVSCSVKAYFALKAAGDSEHAPHMVRARDAILKLGGAARANVFTRILLATFGQVPWRAAPFMPIEFVLFPKWVPISMYKVAYWARTTMVPLLVLCSLKARARNPRNISIRELFVTPPDEERQYFPPARGMRKLFLALDRTVRHVEPLMPKGLRQRAIRHAEAWCAERMNGEDGLGGIFPPIVYCYQMMEVLGYPDDHPLRRDCENALEKLLVTRPDGSMYCQPCLSPVWDTAWSTMALEQARGVAVAEDGEPGDARRALDERITRAYDWLAERQVNDLRGDWIENAPADVQPGGWAFQYANPYYPDIDDTAVVTAMLDRRGRTHANADGTNPYATRVARALDWMRGLQSRNGGFGAFDADCDRLYLNAIPFADHGALLDPPTEDVSGRVLLCFGVTKRADEHASLARCIDYVKRTQQPDGSWWGRWGTNYIYGTWSVLAGLALAGEDKSQPYIARAIEWLRARQHADGGWGETNDSYIDPKLGGTNGGESTSNFTAWALLAQMAFGDCESDSVKRGIAYLQSVQQEDGFWWHRSHNAPGFPRIFYLKYHGYTAYFPLWALARYRRLAGVANKRVSTADKTADAMA

SEQ ID NO: 101 - protein, 657 aa, Burkholderia sp.
MNDLTEMATLSAGAVPAGVDTAVARATDALLAAQNADGHWVYELEADSTIPAEYVLLVHYLGETPNLELEQKIGKYLRRIQQADGGWPLFTDGAPNISASVKAYFALKVIGDDENAEHMQRARRAIHAMGGAEMSNVFTRIQLALYGAIPWRAVPMMPVEIMLLPQWFPFHLSKVSYWARTVIVPLLVLNAKRPLAKNPRGVRIDELFIDPPVNAGLLPRQGHQSAGWFAFFRVVDHALRAVDGLFPNYTRERAIRQAVSFVDERLNGEDGLGAIYPAMANSVMMYDVLGYAEDHPNRAIARKSIEKLLVVQEDEAYCQPCLSPVWDTSLAANALLETRDARAEDAAIRGLEWLRPLQILDVRGDWISRRPHVRPGGWAFQYANAHYPDVDDTAVVAVAMERAQQLKQNDAYRDSIARAREWVVGMQSSDGGWGAFEPENTQYYLNNIPFSDHGALLDPPTADVSGRCLSMLSQLGETPLNSEPARRALDYMLKEQEPDGSWYGRWGMNYVYGTWTALCSLNAAGLTPDDPRVKRGAQWLLSIQNKDGGWGEDGDSYKLNYRGFEQAPSTASQTAWALLGLMAAGEVNNPAVARGIDYLIAEQNAEGLWDETRFTATGFPRVFYLRYHGYRKFFPLWALARYRNLKRDNTTRVTVGL

SEQ ID NO: 102 - protein, 694 aa, Burkholderia sp. CCGE1002
MNDLSQTQPLDAVLPEAADAASNLAEAAVVANAPAVADALATATPSPMQTAGASPLDVSITRATDAILAAQQPDGHWIYELEADATIPAEYVLLVHYLGETPNLELEQKIARYLRRIQLPNGGWPLFTDGALDISASVKAYFALKMIGDPVDAEHMVRARDAILAHGGAEHANVFTRILLALFGVVSWRAVPMMPVEIMLLPMWFPFHLSKVSYWARTVIVPLLVLNAKRPLARNPRKVRIDELFRGAPVNTGMNERAPHQHAGWFGFFRCVDTVLRAVDGLLPKASRERAIRAAVAFVDERLNGEDGLGAIFPAMANSVMMYDVLGYPADHPNRAIARKSLDKLLVIKEDEAYCQPCLSPVWDTSLVAHALLETREARAEQAAERGLAWLRPLQILDVRGDWISRRPNVRPGGWAFQYNNAHYPDVDDTAVVAMAMHRSAALTKSDVDREAIARAREWVVGMQSSEGGWGAFEPENTQYYLNNIPFSDHAALLDPPTADVSGRCLSMFAQIGELPQNSEPAQRAFDYMLQEQESDGSWYGRWGLNYIYGTWTALCSLNAAGMSHDDPRMRRAVQWLVSIQNEDGGWGEGGESYKLDYRGYERAPSTASQTAWALLGLMAAGEVDHDAVARGIDYLQREQREHGLWDETRFTATGFPRVFYLRYHGYRKFFPLWALARFRHLKRNGLTRVTVGM

SEQ ID NO: 103 - protein, 672 aa, Burkholderia thailandensis
MNDMTEMHTLDATAVPAAPAAADAPAPSAATTGLDAAVARATDALLAAQNADGHWVYELEADSTIPAEYVLLVHYLGEEPNAELEQKIARYLRRIQQPDGGWPLFTDGAPNISASVKAYFALKVIGDDENAEHMQRARRAIHAMGGAEMSNVFTRIQLALYGVVPWYAVPMMPVEIILLPQWFPFHLSKVSYWARTVIVPLLVLNAKRPVAKNPRGVRIDELFKSAPVNTGLLPKQPHQHAGWFAFFRAVDGVLRLADGLFPRYTRERAIRQAAAFVDERLNGEDGLGAIYPAMANAVMMYAALGYPEDHPNRAIARQSIEKLLVVGEEEAYCQPCLSPVWDTSLAAHALLETGDERAREAAVRGLDWLVPRQILDVRGDWISRRPHVRPGGWAFQYANAHYPDVDDTAVVVMAMDRVAKHDQTDAYRESIARAREWVVGMQSSDGGWGAFEPENTQYYLNNIPFSDHGALLDPPTADVSGRCLSMLAQLGETSASSEPARRALDYMLKEQEPDGSWYGRWGMNYIYGTWTALCSLNAAGLGHDDPRVKRAAQWLLSIQNPDGGWGEDGDSYKLDYRGYERAPSTSSQTAWALLGLMAAGEVDNPAVARGIGHLLGTQREHGLWDETRFTATGFPRVFYLRYHGYRKFFPLWALARYRNLKRAGAARVTVGM

SEQ ID NO: 104 - protein, 663 aa, Burkholderia thailandensis
MNDMTEMHTLDATAAPAAPTVATGLDAAVARATDALLAAQNADGHWVYELEADSTIPAEYVLLVHYLGEAPNVELERKIARYLRRIQLPDGGWPLFTDGAPNISASVKAYFALKVIGDDENAEHMQRARRAIHAMGGAEMSNVFTRIQLALYGVVPWYAVPMMPVEIMLLPQWFPFHLSKVSYWARTVIVPLLVLNAKRPVAKNPRGVRIDELFKSAPVNTGLLPKQPHQSAGWFAFFRAVDGVLRLTDGLFPRYTRERAIRQAVAFVDERLNGEDGLGAIYPAMANAVMMYAALGYPEDHPNRAIARQSIEKLLVVGEDEAYCQPCLSPVWDTSLAAHALLETGDERAREAAVRGLDWLVPRQILDVRGDWISRRPHVRPGGWAFQYANAHYPDVDDTAVVAMAMDRVAKLDRTDAYRESIARAREWVVGMQSSDGGWGAFEPENTQYYLNNIPFSDHGALLDPPTADVSGRCLSMLAQFGETSASSEPARRALDYMLKEQEPDGSWYGRWGMNYIYGTWTALCSLNAAGLGHDDPRVKRAAQWLLSIQNPDGGWGEDGDSYKLDYRGYERAPSTSSQTAWALLGLMAAGEVDHPAVARGIDHLLGTQREHGLWDETRFTATGFPRVFYLRYHGYRKFFPLWALARYRNLKRANATRVTVGM

SEQ ID NO: 105 - protein, 678 aa, Burkholderia ubonensis
MKPNHTFSPAALDAAILRGRDTLSGLQQPDGSWCFELESDATITAEYILMMHFMDKIDEVRQAQMARYLRAIQRVETHGAWDLYVDGAPDISCSVKAYFALKAAGDSEHAPHMIRAREAILKLGGAARSNVFTRILLATFGQVPWRAAPFMPVEFVLFPKWVPISMYKVAYWARTTMVPLLVLCSLRARARNPRNVSIAELFVTPPDEERHYFPPAKGMRKLFLALDRTVRHLEPLLPRRLRQRAIRHAEAWCAERMNGEDGLGGIFPPIVYSYQMMEVLGYPEDHPLRRDCEDALEKLLVTRADGSVYCQPCLSPVWDTAWSTMALEQARGATPAAPDTQVSERELDARIARAYDWLATRQVNDLEGDWRENARPGTLPGGWAFQYANPYYPDIDDSAVVTAMLDRRGRAQARASGENPYAERVTRALDWMRGLQSRNGGFGAFDADCDRLYLNAIPFADHGALLDPPTEDVSGRVLLCFGVTKRPADRAAAARAIEYVKRTQQPDGSWWGRWGTNYLYGTWSVLAGLALSGEDKSQPYIARALDWLRAHQHADGGWGETNDSYADPRLRATNYGESTSNCTAWALLAQMAFGDWQSDSVRRGIAYLLSVQQDDGFWWHRSHNAPGFPRIFYLKYHGYTAYFPLWALARYRRLAGAQAAPSSPGPGTAATIADPAVA

SEQ ID NO: 106 - protein, 657 aa, Burkholderia ubonensis
MNDLTDMPTLAADSAAADLDAAVARATDALLAAQQADGHWVYELEADSTIPAEYILLVHYLGETPNLELEQKIGRYLRRIQQPDGGWPLFTDGAPNISASVKAYFALKVIGDDENAEHMQRARRAIHAMGGAEMSNVFTRIQLALYGAIPWRAVPMMPVEIMLLPQWFPFHLSKVSYWARTVIVPLLVLNAKRPIAKNPRGVRIDELFIDPPVNAGLLPRQGHQSAGWFAFFRVVDHALRAVDGLFPSYTRERAIRQAVAFVDERLNGEDGLGAIYPAMANAVMMYDALGYPEDHPNRAIARRSVEKLLVVHDDEAYCQPCLSPVWDTSLAAHALLETGDPRAEDAVVRGLEWLRPLQILDVRGDWISRRPNVRPGGWAFQYANPHYPDVDDTAVVVMAMDRVEKLRHSDAYREAISRAREWVVGMQSSDGGWGAFEPENTQYYLNNIPFSDHGALLDPPTADVSGRCLSMLSQLGETAANSEAARRSLDYMLKEQEPDGSWYGRWGMNYVYGTWTALCSLNAAGLGPDDPRVKRGAQWLLSVQNKDGGWGEDGDSYKLDYRGYEQAPSTSSQTAWALLGLMAAGEVNHPAVARGIDYLIAEQKEHGLWDETRFTATGFPRVFYLRYHGYRKFFPLWALARYRNLKRANATRVTVGM

SEQ ID NO: 107 - protein, 657 aa, Burkholderia vietnamiensis
MNDLTDMANLSAGTVPAGLDASVARATDALLAAQNADGHWVYELEADSTIPAEYVLLVHFLGETPNLELEQKIGRYLRRIQQADGGWPLFTDGAPNVSASVKAYFALKVIGDDENAEHMQRARRAIHAMGGAEMSNVFTRIQLALFGAIPWRAVPMMPVEIMLLPQWFPFHLSKVSYWARTVIVPLLVLNAKRPLAKNPRGVRIGELFIDPPVNAGLLPRQGHQSPGWFAFFRVVDHALRAADGLFPSYTRERAIRQAVSFVDERLNGEDGLGAIYPAMANAVMMYDVLGYPEDHPNRAIARKSIEKLLVVHDDEAYCQPCLSPVWDTSLVAHALLETGDARAEQAVLRGLDWLRPLQILDVRGDWISRRPNVRPGGWAFQYANAHYPDVDDTAVVVMAMDRAQKLQNTDTYRESIARAREWVVGMQSSDGGWGAFEPENTQYYLNNIPFSDHGALLDPPTADVSGRCLSMLAQLGESALSSEPARRALDYMLKEQEPDGSWYGRWGMNYVYGTWTALCSLNAAGLGPEDPRVKRAAQWLLSIQNKDGGWGEDGDSYKLNYRGFEPAPSTASQTAWALLGLMAAGEVNHPAVERGIGYLIAQQNDEGLWDETRFTATGFPRVFYLRYHGYRKFFPLWALARYRNLKRANATRVTVGI

SEQ ID NO: 108 - protein, 678 aa, Burkholderia xenovorans
MNDLSQTQPRDAVLPEAAGAVPPASAPAPAAASEAPAASLDTAITRATDAILAAQKPDGHWVYELEADATIPAEYVLLVHYLGETPNVELEQKIARYLRRIQLPDGGWPLFTDGAPDVSASVKAYFALKMIGDPADAEHMVRAREAILANGGAEAVNVFTRILLALFGVVSWRAVPMMPVEIMLLPMWFPFHLSKVSYWARTVIVPLLVLNAKRPLARNPRRVRIDELFRGAPVNTGPRDRAPHQHAGWFRFFSGVDMLLRAVDGLFPKATRERAVRAAVAFVDERLNGEDGLGAIFPAMANSVMMYDVLGYPADHPNRAIARQSIEKLLVIKDDEAYCQPCLSPVWDTSLVAHALLETGEARAEQAAERGLAWLRPLQILDVRGDWISRRPNVRPGGWAFQYNNDYYPDVDDTAVVVMAMHRSAALTHSEVDREAIARAREWVVGMQSSDGGWGAFEPENTQYYLNNIPFSDHGALLDPPTADVSGRCLSMLAQLGELPQGSEPAQRAFAYMLKEQEPDGSWYGRWGLNYIYGTWTALCSLNAAGMPHDDPRMKRAAKWLLSIQNEDGGWGEGGESYKLDYHGYERAPSTASQTAWALMGLMAAGEVNHEAVARGVAYLQREQREHGLWDETRFTATGFPRVFYLRYHGYRKFFPLWALARFRHLKRHGLTRVAVGM

SEQ ID NO: 109 - protein, 657 aa, Candidatus Koribacter
MDDRHIQSEITFGKIDGIRERIQQAMDAAKRYLFSKQDPEGFWCGELEADTTLQSDYIVMHTLLGTGDPVKMQKAGKQILQHQNPDGGWNIYPDGPSNISAAVKAYFSLKLIGHKPDEPEMTKAREWILAHGGVTACNTFSKMYLCFFGQYDYDTVPAIPPEIVLFPNWFWFNLYEISSWSRGILVPLAICYAKKPFKKIPDEANIDELFVEGRHANLHLTWDKKPFSWRNFFLVLNNMVHFFERVHVRPLRKLAMKRAEKWMLERLEMSDGLGGIYPAILNSIIALRALGYSTDDPQVIRAMDEFEKLGIEEDDTFRMQPCMSPVWDTAYALYALGEAGVPGSDPRMQKAAEWMLKKQVTHKGDWAVKVRNVQPGGWYFEFNNEFYPDVDDTAQVILSLNHVRTSNERYQDDTVKRALDWQLAMQCKNGGWASFDKDNNKMVFQYIPFADHNAMLDPATVDITGRVLEALSHHGYSLKDKVVQRAVKFIQSEQEPDGSWFGRWGVNYIYGTMLCLRGLAAVGVDHHEPMVQQAAEWLRMVQNPDGGWGESVGSYDDPKLRGQGPSTASQTAWAVMGLLAANDLRSDSVTRGIAWLLENQKPNGSWWEKWITGTGFPRVFYLKYTMYAEYFPLIAFAEYLRRLNTPLDEKVKLGPQA

SEQ ID NO: 110 - protein, 488 aa, Candidatus Kuenenia
MILFPAGFYFSIYEISYWSRCIVVPLSIAIARKPHVTVGDDLLKELYLVPREDVVYRIERDQDGFCWYNFFIDADSIFRRYEQHPIKFIRRIAKKMAEKWLLEHMEKSGGLGAIWPAMINSIFAMKCLDYPDDHPALTAQMKEVEALVIYEGDMLYLQPCVSPVWDTAWSIIAMNDSGIPGSHPVLQKAGKWLLSKEVRDFGDWKLKCKVEEPSGWYFQYANEFYPDTDDTGAVLMALQRVSLPEDMHKEKTLLRALRWLQAMQCDDGGWGAFDRNNNKTILNNIPFADFNALLDPSTSDVTGRCIEFFGRIGFNKTYLNIKKAVEFLKKEQDEDGSWFGRWGSNYIYGTWSVISGLIAVGEDINKAYIKKAIAWLKSVQNSDGGWGETIKSYEDSALKGIGKSTPSQTAWALLTLITAGEIKSSSTERGIDFLLSTQKEDGSWDEREFTATGFPKVFYLKYHMYRNYFPLMALGRYRHFTHKLATSQ

SEQ ID NO: 111 - protein, 641 aa, Candidatus Solibacter
MSYEWTEPVRPGRRHAVSPVQNFCQSLAPAIQRACDALFSQQAADGFWCGELTADTTLESDYILLQLWLNQPDDHGWNPPTRPRIDRAGRSILERQLPDGGFNIYAGGPSEVSATIKAYCALKLAGLDPHSPPLRRARERILALGGLQAANSYVKINLSLFGLYPRKHVPSVPPEIVMLPGNVLYEMSSWTRSILVPLSIVQARGSNRRAPNGFNLDELLLPGVKLALPKRKGLAVLFHHLDRMFKVWEKRGSERIRGAAIREAERWLIARTHYTEGLGAIYPAMMYFIMALDALGYAEDHPDRSEAIRHFESLLIETDDRFLFQPCVSPVWDTAICAFALGEAGNTDDPRMTLAADWLISKEVRRKGDWSIKRPDTEPSGWAFEFANEFYPDIDDTAMVLLALMHANGSNPEAQAAAERRAVNWLLAMQSSDGGWAAFDVDNNWAMLNQVPFADHNAMLDPTCPDITGRVLECLCRRGMAGHDAARRGVAYLLQAQEKDGSWYGRWGVNYIYGSFLAMRGLTTSGAPGSQDAVDRAARWLRAIQNPDGGWGESCASYARDGYVAAPSSASQTAWALLGLCAAGDRDSAQFRRGVEYLLTLQAPDGKWPEGATTGTGFPNVFYLTYAMYRDYFPLLALSQV

SEQ ID NO: 112 - protein, 641 aa, Candidatus Solibacter
MSAPSHVGNTLEHAAELATRKAMAYLTCLQERDGHWCAELTADTTLESDYILFQLWLYPPQDGKWEPETRPLIRKAVNSILERQLPDGGFNICVGGPSEVSASVKAYVAMKLAGLPPEDDRMARLRERILALGGIQAANSYVKVNLSLFDLYPREFSPSIPPEVALLPFDLLYQMSAWTRAIVISLGIVHAANPRRPAPAGFNLQELWLPGVSPEFRRDPSFFTWHNTFLTVDKALKLWERYGSKAVRRRAVEKAKTWMIERLHHSDGLGAIYPPMMYSVMALDVLGYAKDDPLRVEALRHFNNLMVDDGDRFFFQPCFSPVWDTAIGAYALVQADPSHEAIAPAADWLIAKEVRRKGDWSVKRPNTEPSGWAFEYSNEYYPDIDDTAMVMLALGETRASNTEAQAAACKRGLAWLLAMQSSDGGWAAFDADNNWEFLSQVPFADHNAMLDPTCADITGRVLEALASQGLDRNHKAVRRGAEWLIRHQENDGSWYGRWGVAYIYGTCFALRGLAASGENDREAHILRAGEWLRSIQNADGGWGESCKSYDNRIFTGGPSTPSQTAWAILGLIAGGDANSLSVQHGIEYLLETQRSDGSWDEQFATGTGFPRVFYLNYHMYKDYFPLLALASFVKARAGSNG

SEQ ID NO: 113 - protein, 644 aa, Catenulispora acidiphila
MTDVIDKAVAATGPADPSQGAAATLQAAADHLLGLQDDAGWWKGELETNVTMDAEDLLLRQFLGIRTEEVTREAGDWIRSQQRADGTWANFFDGPADLSTTIEAYTALRMAGDAKDAEHMRAARTYILDSGGIEASRVFTRIWLALFGEWQWSDLPVMPPELIYLPKWFPLNVYDWACWARQTVVPLTIVNALRPVRPLGFDLKELRTGRRAPAQRGLFSTLDRALHVYERKPLRSVRDAALRRSADWIIARQEADGSWGGIQPPWVYSLMALNLLGYGVDHPVMRKGIEGLDRFTIRDERGRRLEACQSPVWDTVLAMTALRDAELPENHPALVKAADWVLGEEITNPGDWSVRRPRVAPGGWAFEFDNDGYPDVDDTAEVVLALNRVAHPDAPAAIRRGVDWLEGMACKDGGYGAFDADNTRTLALKLPFCDFGAVIDPPTADVTAHTLEAYAALGLANSRASQRALEWLVKAQERDGSWFGRWGANHVYGTGAVVPAMVAVGVDPEDEMIRRAVRWLEEHQNDDGGWGEDLRSYRDKSWIGRGVSTASQTAWALLALLAAGEERGTAVEQGVRFLIRTQRADGTWDEDHYTGTGFPGDFYLNYHLYRLVFPISALGRYVRAVGAAGDGGDAGHAGHAGTVS

SEQ ID NO: 114 - protein, 657 aa, Chthoniobacter flavus
MIFTDTPTGSTQNRLDVAIRRAQQNLLRLQHNEGYWCGELFVDSTLCSDYVLFMHWADEIDPVMEEKCVAHIRRRQLEDGGWNIYEGGPSDVNATVKAYFALKLAGHAPTQPWMQEARACILRLGGIPKMNTYAKLYLALLGQFPWRYLPTVPVEIMFMPRWFFFDIYEVSSWSRAMLMPLAILNHYKPTKHLPADKQLHELYPIGSEESDLGLGMQKPRFSWPNFFLFCDRLIKIMHSLPWKPWKRAALARAEAWMTQRMGEGSDGLAAIFPAMLNSMIALRTLRYSREHPLYVKAKNDFAGLFVDDPQDFRIQPCLSPVWDTAINLVALLESGLDPHDPKIEAAVNWLKEKEVRINGDWYVKNHHVPPSGWAFEFNNVYYPDTDDTMMVLAALARAGAHEESAPVETKAMFERALKWLLSFQCRDGGWAAFDKDVTQGWLEDVPFADHNAILDPTCSDLTGRVLELLGLIDYDRNCTPVRRALKFLRDTQEDDGSWYGRWGVNYIYGTWQVLRGLRSIGEDMRQQWIVRARDWLESCQNEDGGWGETCASYDDPTLKGKGPSTASQTAWALMGLIAAADPTEPGAFDRKSIRQGVDYLLSTQVADGSWVEPEVTGTGFPRVFYLRYDMYRNNFPLMALATYRKAREGKLPVRQRE

SEQ ID NO: 115 - protein, 603 aa, Chthoniobacter flavus
METLSRSRLEAALAKATQALLTELNPAGHWSGELSSSALSTATAIVALGAVDREQQRELIAGGMRWLAQHQNADGGWGDTVKSRSNISTTALCWAAVSTSTEHAESAAKAEAWLTRAAGSMAQLVPAIEARYGKDRTFSVPILMHLAICGRVSWSQIPALPFELAALPHQLFGALQLPVVSYALPALIAIGQAIHHHAPPTNPLLNGLRKSARARTLEVLESIQPQNGGFLEATPLTSFVTMALASAGEAQHPVARRGVSFLQASVQRDGSWAIDTNLATWVTTLSIKALAHQPGALSPERALTLREWLLGQQYVVEHPYTHAAPGGWAWTDLPGGVPDADDTPGALLALLHLGVVDAPTRQAGQIGVRWLLDLQNRDGGIPTFCRGWGALPFDRSSPDLTAHTLRAWTAWLPQLDESLKRRTLRAVTKAIHFLATHQRTDGSWLPLWFGNEHAPDDENPLYGTAKVVIALRELLNRDFTLPNGMLERALCWLVERQDISGGWSGAKNGPVSVEETALAVEALAGTGHVSATDRGAAWLTEQIEADTWREPAPIGFYFAKLWYYERLYPQIWTVGALGRVAALRVGESESDTPAGLHRATSET

SEQ ID NO: 116 - protein, 645 aa, Crocosphaera watsonii
MQTQDRLTQKQPLSLKDAITASQNYLLSLQYPQGYWWAELESNITLTAETVLLHKIWGTDKTRPLHKVEAYLRQQQREHGGWELFYGDGGEISTSVEAYMALRLLGVPQDDPALIRAKDFIISKGGISKTRIFTKFHLALIGCYDWKGIPSIPPWIMLFPDSFPFTIYEMASWARESTVPLIIVFNDKPVFSVDPVFNLDELYAEGVENVKYELPKNNNWGDIFLGIDQVFKFAEQVDLVPFRKEGLKAAEKWILNHQQETGDWGGIMPPMLNSLLAFRTLNYDVNDPSVKLGFEAIDRFSIEEDDTYRLQACVSPIWDTAWCVRALTDSGLEKDHFSLVKAGKWLLDKQVMEYGDWAVKNKAGKPGGWAFEFTNRFYPDLDDSATVVMALNGIKLPDEARKQAAINRCLQWIETMQCKEGGWAAFDLNNDQAWLNEVPYGDLKAMIDPNTADVTARVVEMLGSCDLEIESDRLNKSLNYLYKEQEKDGSWFGRWGVNYIYGTSGVLSALAVINPEKHKTQMEQGINWLLSCQNKDGGWGETCRSYNDPSLKGKGVSTPSQTAWSLIGLLDAGEALNKFETDAIERGVNYLLDTQTEEGTWEESEFTGTGFPCHFYIRYHFYRHYFPLIALGRYQNLSSEFGVRS

SEQ ID NO: 117 - protein, 681 aa, Cupriavidus taiwanensis
MNETAFANPAPQVGPAQRQPAAPQEAPAARLPAPALDRGIDRALDALLHQQRPDGHWVYELEADATIPAEYVLMVHYLGEDPDRDLEARIARYLRRIQNPDGGWPLFHQGRSDISASVKAYFALKMAGDDPQSAPMQRARQAIHAMGGAEATNVFTRTLLALYGVLPWKAVPMMPVEIMLLPRWFPFHLSKVSYWARTVIVPLLVLNSLRPQARNPRGVGINELFVGNCHTVGLPPRAAHQHAGWYTVFRGLDALLRLAEPLFPRTLRRRAIAAAQRFVRERLNGEDGLGAIFPAMANSVMMFDVLGVPPEDPARAVARRSIERLLVEHGDEAYCQPCLSPVWDTALATHALLETGEARAAQAAGRALDWLRPLQVLDLRGDWAVRRPLVRPGGWAFQYANAYYPDVDDTAVVAAAMDRFMRAHHAPGRYGEAVARATEWIVGMQSGNGGWGAFEPENTHLYLNNIPFADHGALLDPPTADVSARCLSMLCQTGATPANSEPAARALRYLLAEQMPDGSWFGRWGTNYIYGTWSALCALNAAGLPPEAPELCRAVAWLARIQNADGGWGEDGSSYRLDYSGYEPAPSVASQTAWALLALMAAGAAQHPAVARGIDYLLRTQQPGGLWHEPRFTAVGFPRVFYLRYHGYARYFPLWALARYRNLQRGLGDHGGNSGQVAWGL

SEQ ID NO: 118 - protein, 663 aa, Cyanothece sp.
MLTYKEYRRSVTEIAMQTRDRQTQKPALSLNDAITASQNYLLSLQYPQGYWWAELESNITLTAETVLLHKIWGTDKTRPLHKVEAYLRQQQREQGGWELFYGDGGEISTSVEAYMALRLLGVPQDDPALIRAKDFILSKGGISKTRIFTKFHLALIGCYSWKGIPSIPPWIMLFPNSFPFTIYEMASWARESTVPLIIVFNDKPVFAVDPIFNLDELYAEGIENVKYELPKNNNWGDIFLGLDKVFKFAEQVDLVPFRKKGLQAAERWMLNHQQETGDWGGIMPPMVNSLLAFRVLNYDVNDPSVQRGFEAIDRFSIEENETYRVQACVSPVWDTAWCVRALTNSGLPKDHFSLVKAGKWLLEKQCLEYGDWAVKNKTGKPGGWAFEFTNRFYPDIDDSAVVVMALNGIKLPDEARKQAAINRCVKWIETMQCKEGGWAAFDVDNDQAWLNEVPYGDLKAMIDPNTADVTARVVEMVGSCDLEISSKRLNKALNYLYKEQEKDGSWFGRWGVNYIYGTSGVLSALAVINPEKHQPQIEQGINWLLSCQNKDGGWGETCWSYNDSNLKGKGISTASQTAWALIGLLDAGEALNHFETDSIQRGISYLLNTQTEEGTWEESEFTGTGFPCHFYIRYHFYRHYFPLIALGRYQNLSSEFGIRNSEL

SEQ ID NO: 119 - protein, 643 aa, Cyanothece sp.
MQIQDRNSSPQVTEVLNQVKDAIAASQDYLMSIQYPEGYWWAELESNVTITAEVVLLHKIWGTDKTRPLHKVETYLRRQQREHGGWELFYGDGGDLSTSVEAYMALRLLGVSIDDPALIRGREFILKRGGISKSRIFTKLHLALIGCYDWRGIPSIPPWIMLLPENFPFTIYEMSSWARSSTVPLLIVFDKKPVYCCDPTINLDELYSEGIENVKYDLPKTGDWTDIFVWLDGVFKFAQDYNLVPLRQESLQAAERWVLERQEDSGDWGGIIPAMLNSLLALRALNYEAVDPIVHRGLQSVDNFAIETEDTYHVQPCISPVWDTAWAIRALVESGLKADDPRLVKGAQWLLDKQILDYGDWAVKNKQGTPGGWAFEFDNRWYPDLDDSAVVVMALDQVKMPNEDLKNGAIRRCVRWMATMQCKDGGWGAFDLDNDQNWLNFLPYADLKAMIDPNTSDVTARVLEMLGTCGLIMDSNRVQKAIAYLEKEQEPDGSWFGRWGVNYIYGTSGVLSALAVIAPETHQKELKKGAAWLVGCQNADGGWGETCFSYNDSSLKGKGDSTASQTAWGLIGLLAAGEATGEFFKTAIERGVNYLLKTQREDGTWDENYFTGTGFPCHFYLKYHLYLQYFPLIALSRYQRLLT

SEQ ID NO: 120 - protein, 651 aa, Cyanothece sp.
MQTQNRVTSTQKVELSNLTQAIIASQNYILSRQYPEGYWWGELESNITLTAETVLLHKIWKTDKTRPFHKVETYLRRQQNEQGGWELFYGDGGELSTSVEAYMALRLLGVTPEDPALIRAKDFILSKGGISKTRIFTKFHLALIGCYDWKGIPSIPPWIMLFPDNFPFTIYEMSSWARESTVPLLIVFDKKPIFEIEPAFNLDELYAEGVENVKYALPRNHNWSDIFLGLDKLFKWTEKNNLVPFHKKSLQAAEKWMLNHQQESGDWGGIMPPMVNSLIAFKVLNYDVADPSVQRGFEAIDRFSIEEEDTYRVQACVSPVWDTAWVIRALVDSGLKPDHPSLVKAGEWLLDKQILEYGDWAIKNKQGKPGGWAFEFINRFYPDLDDSAVVVMALNGIKLPDENRKKAAINRCLEWMATMQCKPGGWAAFDVDNDQAWINEIPYGDLKAMIDPNTADVTARVLEMVGSCGLKMDENRVQKALFYLEKEQESDGSWFGRWGVNYIYGTSGVLSALAVIAPNTHKPQMEKAVNWLISCQNEDGGWGETCWSYNDSSLKGTGISTASQTAWAIIGLLDAGEALETLATDAIKRGIDYLLATQTPDGTWEEAEFTGTGFPCHFYIRYHLYRHYFPLIALGRYWKIGLKTPSVIPLN

SEQ ID NO: 121 - protein, 647 aa, Cyanothece sp.
MQTQNRVTSTQKVELSNLTKAIIASQNYIMSRQYPEGYWWGELESNITLTAETILLHKIWKTDKTRPFHKVETYLRRQQNEQGGWELFYGDGGELSTSVEAYMALRLLGVTPEDPALIRAKDFILSQGGISKTRIFTKFHLALIGCYDWKGIPSIPPWIMLFPDNFPFTIYEMSSWARESTVPLLIVFDKKPIFEIEPAFNLDELYAEGVENVKYALPRNHNWSDIFLGLDKLFKWTEKNNLVPFHKKSLQAAERWMLNHQQESGDWGGIMPPMVNSLIAFKVLNYDVADPSVQRGFEAIDRFSIEEEDTYRVQACVSPVWDTAWVIRALVDSGLKPDHPSLVKAGEWLLDKQILEYGDWAIKNKQGKPGGWAFEFINRFYPDLDDSAVVVMALNGIKLPDENCKKAAINRCLEWMATMQCKPGGWAAFDVDNDQAWINEIPYGDLKAMIDPNTADVTARVLEMVGSCGLKMDENRVQKALFYLEKEQESDGSWFGRWGVNYIYGTSGVLSALAVIAPNTHKPQMEKAVNWLISCQNEDGGWGETCWSYNDPSLKGTGVSTASQTAWALIGLLDAGEALETLATDAIKRGINYLLDTQTPDGTWEEAEFTGTGFPCHFYIRYHLYRHYFPLIALGRYWKIGLKNLKG

SEQ ID NO: 122 - protein, 643 aa, Cyanothece sp.
MQIQARNISTKVTEVFSKVKEAIAASQQYLLSIQYPEGYWWAELESNVTITAEAVLLHKIWGTDTTRPLHKVETYLRRQQREHGGWELFYGDGGDLSTSVEAYMALRLLGVSASDPALVRAKAFILSRGGISKSRIFTKMHLALIGCYDWRGVPSIPPWIMLLPENFPFTIYEMSSWARGSTVPLLIVFDKKPVYQCGITLDELYSEGINHVRYDLPRNGDWTDVFVWLDGVFKFAETNNLIPFRNESLKAAERWVLERQEDTGDWGGIIPAMLNSLLALRALDYEVNDPIVHRGFKSVDNFAIETEETYHVQPCISPVWDTAWVLRALVESGLKPDEPVLVKGAQWLLDKQILDYGDWAVKNKEGTPGGWAFEFDNRWYPDLDDSAVVVMALEQVKMPDEQLKYGAMRRCVRWMATMQCKAGGWGAFDVNNDQNWLNYLPYADLKAMIDPNTADVTARVLEMLGTCELSMDHDRVKRAIAYLEQEQEADGSWFGRWGVNYIYGTSGALSALAAIAPVTHQAQIEKGAAWLVGCQNPDGGWGETCFSYNNPALRGKGDSTASQTAWGLIGLLAAGEATGKFAKTALERGVNYLLATQRPDGTWDESYFTGTGFPCHFYLKYHLYLQYFPLIALSRYQRLLGFN

SEQ ID NO: 123 - protein, 640 aa, Cyanothece sp.
MQTRDRQTHKPALSLNDAITASQNYLLSLQYPQGYWWAELESNITLTAETVLLHKIWGTDKTRPLHKVEAYLRQQQREHGGWELFYGDGGEISTSVEAYMALRLLGVPSNDPALIRAKNFIISQGGISKTRIFTKFHLALIGCYSWKGIPSIPPWIMLFPNSFPFTIYEMASWARESTVPLIIVFNDKPVFAIDPIFNLDELYAEGIENVKYELPKNNNWGDLFLGLDKVFKLAEQVDLVPFRKQGLQAAERWMLDHQQETGDWGGIMPPMVNSLLAFRVLNYDVADPSVQRGFEAIDRFSIEENDTYRVQACVSPVWDTAWCIRALTDSGLPKDHFSLVKAGKWLLEKQVLEYGDWAVKNKTGKPGGWAFEFTNRFYPDIDDSATVVMALNGIKLPDEALKQAAINRCLKWIETMQCKAGGWAAFDVDNDQAWLNEIPYGDLKAMIDPNTADVTARVVEMVGSCDLEMSSDRLNKALDYLYEEQEKDGSWFGRWGVNYIYGTSGVLSALAVINPKQHKSQIEQGMNWLLSCQNEDGGWGETCWSYNDLSLKGKGVSTPSQTAWALIGLLDAGEVLNHFETDSIERGINYLLNTQTEEGTWEESEFTGTGFPCHFYIRYHFYRHYFPLIALGRYQQMLGS

SEQ ID NO: 124 - protein, 668 aa, Cyanothece sp.
MQIRATVDTAKLEKAIAASQEHLLSTQYPEGYWWAELESNVTMTAEVVLLHKIWKTDGTRPMHKAEKYLRSEQREHGGWELFYGDGGDLSTSVETYTALRLLGVPASDPALLKAKDFILRRGGISKTRIFTKLHLALIGCYDWRGLPSLPPWVMLLPENFPFTIYELSSWARGSTVPLLIVMDRKPVFSVNPQINVDELYAEGRDRVKFELPRKGDWTDLFIELDGLFKFTEQNNLVPFREEGLRAAERWVLERQEATGDWGGIIPAMLNSLLALRALGYHPADPYVRRGMAAVDRFAIETADTYRVQPCVSPVWDTALVMRGLIDSGLPADHPAIVKAGEWLLEKQILAYGDWAVKNKTGQPGAWAFEFENRFYPDVDDSAVVVMALQAAQLPDEDLKQQAIERCVKWIATMQCKPGGWAAFDVDNDQDWLNQIPYGDLKAMIDPNTADVTARVLEMIGRSGVTTGEASVERALAYLRREQEVEGCWFGRWGVNYIYGTSGVLAALALIAPKSDHAMIQRGADWLVRCQNADGGWGETCRSYNDPHLKGQGPSTASQTAWALIGLLAAGEATGEFAWGAIDRGINYLLATQQQDGRWDEDWFTGTGFPGHFYLKYHLYQQHFPLTALGRYSSLTGLKQELKIPLQLKSKPEVVMIEDSDLLSDEDAT

SEQ ID NO: 125 - protein, 651 aa, Cyanothece sp. PCC 8802; identical to SEQ ID NO: 120

SEQ ID NO: 126 - protein, 705 aa, Desulfovibrio salexigens
MNKKSAMKLKKKAKNHVVSLLQPTDALNRVMKRFRSLQSPEGYWVFALEADVTIPSEYIMFNRFLGRKMDKGLAERLGNYIRAKQMADGGWPLHDNDGPVNISASVKAYMALKMLGDNKDAEHMVRARQIILAKGGAETANVFTRICLATFGQIPWHCPPAMPIEIVLLPKWFFFHLDKVSYWSRSVIYPLLIIYAKQPVCRLRPEEAVPELFCKPAEEHIHIDKYRDKGWRKNLFILLDRVLKRTIHLVPKSINKKALNYAEKWTREHMAGRGGIGAIFPAMANAVMALSLLGYDESDPDFARGMQSVDDLMVDKFHVPEKSPWEHTVITGGAELSAAPELDISPDHGTAENLEQAMCQPCNSPIWDTCLTLSAMMEAGENQDSKSTQQALNWLWDQQIFFRGDWISKAPKLEGGGWAFQFENTFYPDLDDTAMVLMAMCRAGVLDQPEHRENFIKGVNWLIGMQSSNGGWAAFDIDNCAEYLNDIPFADHGALLDPPTSDLTARVIELLGVLGYDKSFRPIKDGIEFLKKEQEDDGSWFGRWGVNYIYGTWSVLCGLRQAGEDMNSSYVCKAVEWFENHQNKDGGWGESCLSYNDKNYAGLGDSTASQTAWALLGLMAAGRVHSKAVSRGVRYLLDTQKDDGSWDESLFTGTGFPRVFYLRYHGYSQYFPMWALGVYQRFSADEDTKQIMMRRKSPLDLGRKW

SEQ ID NO: 127 - protein, 685 aa, Dryopteris crassirhizoma
  Misc_Feature (145)..(145): Xaa is any naturally occurring amino acid
MLPYNQDFYNEDEALKDDHCEGAGNVSNPPTLDEAIKRSQDFLLSQQYPEGYWWAELEGNPTITSHTVILYKILGIEDEYPMDKMEKYLRRMQCIHGGWELFYGDGGQLSVTIESYVALRLLNVPPTDPALKKALKFIIDKGGVXKSRMFTKICLALLGCFDWRGIPSLPPWVMLLPGWFLSSIYETACWARGCVVPLIVVFDKKPVFKVSPEVSFDELYAEGREHACKTLPFCGDWTSHFFIAVDRVFKMMERLGVVPFQQWGIREAEKWLLERQEDTGDFLGVYPPMFYSVVCMKTLGYEVTDPVVRRALLSFKKFSIERADECSVQSSLSPVWDTALVVRSLVESGLPPDHPALQRAGEWLLQKQITKHGDWSFKNQSGVAGGWAFQFFNRWYPDLDDSAVVVMALDCLKLPNEDVKNGAITRCLKWISSMQCKGGGWAAFDKDNHQHWINSTPFSDLKAMVDPSTTDISARVLEMVGRLKLHGTSFDEAHFLPPESIARGLVYLRREQENEGCWFGRWGVNYIYGTCGALVALSLVAPMTHEEEIARGARWLVQVQNMHGKKINGPQDGGWGETCFSYNDPALKGQGDVSTASQTAWALQGLLAAGDALGKYEVESIGHGVQYLLSTQRKDGSWHESQFTGGGFPIHFYLRYHFYAQHFTLSSLARYRTRLQASKIKPPIP

SEQ ID NO: 128 - protein, 747 aa, Frankia alni
MPDLELRDVDRADGRHHAPNLGRTDTLSPSAPTGEPAPASTPAAVATPTPTPTTAPAPAPAPENALRETVQRAAEHLLRLQDPRGWWKFDLETNPTMDAEDLLLREYLGIRTVEQTEATAKHIRSRRLDDGSWPTYFGGPGELSTTVECYIALRLAGDSPDDEPLRRSAAWIRERGGIPATRVFTRIWLALFGWWRWEDLPVLPPEIMFLPPRAPLSIYSFASWARQTIVPLTIVSAARPQCPAPFDLAELDPDEVPAAQSHGAAQSPDTRSPAGGRTLRGAMRRLGGDRPNTAKVFFRGLDAALHRYHRHPIGPLRRHALRTAERWIIARQEADGCFGGIQPPAVYSIIALRLLGYDLDHPVLAAALRSLDAYTLHREDGSRMIEASQSPIWDTALAVLALADAGIDAPADVDVAPALPTQRVATGAPAPSAPVPTALERAADWLLGQEIQHRRGDWAITHPGVAPGGWAFEFDNDTYPDTDDTAEVVLALHRLNRLRRLRHPTNTRIDAALERSTAWLFALQSRDGGWGAYDSDNASTLVYQIPFADFGALTDPSSADVTAHVVELLCETGRIRDPRTLRGVDWLLRNQEADGSWYGRWGVNYVYGTGSVLPALQAAGLPPTHPAMVAGARWLLSRQNSDGGWGEDIRSYGDPAWSGRGLSTPSQTAWAMLGLLATDHGGVHADALAAAARWLTEQQRPDGGWDEEMFTGTGFPGFFYLNYHGYRLVWPVMALGRYLHSRQHPSD

SEQ ID NO: 129 - protein, 704 aa, Frankia alni
MSLTSDPSPAAPTAEKSPKRPTIPVPATADAYGISRSSPPLPAATGRPQAAGPASAGVATARARDHLLALQSEEGWWKGDLETNVTMDAEDLFMKQFLGIRGDDETEQTARWIRSQQLADGGWPTFYGGPADLSTTIEAYIALRLAGDAVDAPHMARAAELVRAQGGVAASRVFTRIWLAALGQWSWDDVPVIPPELIFLPSWIPLNVYDFACWARQTIVALTIVGSLRPSHDLGFSIDELKVPAAARKPAALRSWEGAFERLDKLLHRYEKRPIKLLRTLALRRATEWVVARQEADGCWGGIQPPWVYSVMALHLMGYPLNHPVIATAFRGMERYVIRRDTPQGPIRQIEACQSPVWDTALAVVALADAGVPGDHPAMVKAGRWLVDEEVRVAGDWAVRRPELAPGGWAFEFDNDFYPDVDDTAEVVLALRRLLGAGHVAPPASRQGRAEAPPVNTVEDADPRLAAAMRAAAARGVDWSVGMRSSNGAWGAFDADNVRTLTTKIPFCDFGEVVDPPSADVTAHIVEMLADLGRSDHPITQRAVQWLLDNQEPGGSWFGRWGVNHLYGTGAVVPALIGAGVPTDHPAITAAVRWLLEHQSPEGGWGEDLRSYTDPAWIGRGELTASQTAWALLALLAVDPHSLAVKRGVRWLCETQRPDGTWDEPYFTGTGFPGDFSLNYHLYRLVFPLTALGRYVSLTGVATP

SEQ ID NO: 130 - protein, 741 aa, Frankia sp.
MSLTSDPSPAAPKAAKSSKRVNIPAPATPDAYGISRSSPPLSGGGVSGGGVSGGGAATADGTPPTTQTSVDPDLAAAMTAANQARDHLLGLQSEEGWWKGDLETNVTIDAEHLFMKQFLGIRTEEETEPIARWVRSQQLADGGWATYYGGPAELSTTVEAYIALRLAGDEPDAPHMAAAAALIRSQGGVAAARVFTRIWLATFGEWSWDDVPVLPPELIFLPSWFPLNVYDFGCWARQTIVALTIVGSLRPVRDLGFSIDEIKVAAPVTPPKPAPLHSWEGAFERLDAILHRYERRPIKVLRTLALRRATEWVVARQEADGCWGGIQPPWIYSVMALHLMGYPLNHPVIATAFRGMERYIIRRETPEGPTAQIEACQSPVWDTALAVVALSDAGVPADHPAMVRAGRWLVDEEVRVAGDWAVRRPALAPGGWAFEFDNDFYPDTDDTAEVVLALRRLLGGSHVTPGGTVTPSGSVTPGGTAELSPAARDRASRGLAAVDPQLAGAMRAAAARGVDWSVGMRSSDGAWGAFDADNVRTLTAKIPFCDFGEVVDPPSADVTAHIVEMLADLGRSDHPITRRAVQWLLDNQEPGGSWFGRWGINHVYGTGAVVPALIAAGVPADHPAITAAVRWLLEHQSPDGGWGEDPRSYDDPAWIGRGELTASQTAWALLALLAVDPHSKAVKRGVRWLCETQRPDGTWDEPQFTGTGFPGDFYLNYHLYRLVFPLTALGRYVTLTGVATP

SEQ ID NO: 131 - protein, 728 aa, Frankia sp.
MSLTSDQSSAAPTAAAQSPKIPNPSVARPSADAGSFETAGAVRTDSVSIDSVSTGTPVDPVVGAMRRGRDHLLSLQAEEGWWKGELETNVTMDAEDLMLRQFLGILTPSTATETGRWIRSQQLSDGGWATFYGGPSDLSTTIEAYVALRLAGDDPDAPHMRSAAEWVRSAGGIAASRVFTRIWLALFGEWSWDDVPVLPAEMTFLPPWFPLNIYDFACWARQTVVALTIVGSLRPVRSFGFTLDELRVQAPKATKAPLRSWAGAFERLDSVLHRYEKRPFQPLRRLALRRAAEWVIARQEADGCWGGIQPPMVYSIMALHLMGYPLNHPVISMAFRALDRFTIREETPEGTVRRIEACQSPVWDTALAVVALADAGLGGDHPAMVRAGRWLADEEVRVAGDWAVRRPTLAPGGWAFEFDNDFYPDVDDTAEVVIAIRRLLGDGHGPVDHSDGSGPGSAAATAASAAAEAAVAAAGTIAAADPELAARLRAAAERGVDWSVGMRSSNGAWAAFDADNVRTLVRKIPFCDFGEVVDPPSADVTAHMVEMLALLGRSDHPITQRGVRWLLDNQEAGGSWFGRWGVNHVYGTGAVVPALISAGVDAEHPAIVSSMHWLVEHQTPEGGWGEDLRSYRDDEWIGRGEPTASQTAWALLALLAAEPASGTAEWEAVERGVRWLCDTQRPDGTWDEPQFTGTGFPWDFSINYHLYRLVFPVTALGRYVTLTGRSTS

SEQ ID NO: 132 - protein, 689 aa, Frankia sp.
MFQGSDRPPVTLVMNDMRGPDMNVSDTVSVTRESIPTQTSAGDATARDLTAAVGSELTRALRLATDHLLALQDGTGWWKFDLETNTSMDAEDLLLREYLGIRTTEVTAASARFIRSRQSDDGSWPQYFGGPGELSTTVESYIALRLAGDDASAPHMLSAATWVRDHGGVPATRVFTRIWLALFGWWRWEDLPALPPEIMLLPRRAPLNIYSFGSWARQTLVSLTVVSALRPVRPAPFDLDELYPDGPASAWSGAGPSNVLERISTRFTAKEIFLGIDRLLHVYHRRPVRSMRNHALRAAERWIIARQEADGCFGGIQPPAVYSIIALRLLGYELDHPVLKAALRALDDYSVTLPDGSRMVEASQSPVWDTALAVNALADAGATAAIAPDHPALVRAAGWLLGQEVRHRRGDWAVNHPDVPASGWAFEFENDTYPDTDDTAEVLLALRRVRHPARDELDAAERRAVAWLFGLQSSDGGWGAYDADNTSTIPYQIPFADFGALTDPPSADVTAHVVELLAEAGLGGDDRTRRGVDWLLDHQEADGSWFGRWGVNYVYGTGSVMPALRAAGLEPSHPAMRAGADWLLTHQNADGGWGEDLRSYTDPEWSGRGESTASQTAWAMLALLTVGDQPEVSGALARGARWLADHQRPDGSWDEDQFTGTGFPGDFYINYHGYRLLWPIMALGRYLRG

SEQ ID NO: 133 - protein, 773 aa, Frankia sp. EuI1c
MTTTDETALAAGTPKAAFAPAPRGAADDLVARTVAVEAPPSPAPASDDTLARAVAHLKSLQDEAGWWKGDLETNTTMDSEDLMLRHWLGIWNPEQAERTARFIRSKQYADGSWPIYHAGPGDLNATVESYVALRMVGDSPQDPHMRAAAAWARARGGVPATRIFTRIWLALFGWWRWEDLPVLPPELIFVPAKMPLSIYKFASWGRQTIVAIMVLMAHRPAGTPPFPIAELFPPPATKKKAAAQRKAQKKAGHAGGPTAWRDSSIDDMFTEPAPGTDTLRQPAALAIGPARPAPAKGRRGKGQPAAPDVMGRAKDGGGPGLPLPARLVSRVGFRTRRALRQAALDHVNWNLLFGGIDRFLHVYHRHPIRPVRSLALGLAERWIVVRQEADGCFGGIQPPTVYSIMALRVLGYPMDHPVMTAALRSLDEYSVTLPDGARMQEACQSPVWDTCLATIALADAGVPRDDPSLVRAADWMLAEEVRERRGDWSVPIPDVPTGGWSFEFDNDTYPDVDDSAEVMLALMRVAHPRPEKVVAATYRGLQWVFGMQCADGGWGAFDVDNAGELVYKIPFADFGMLTDPPSADVTAHVVELLGELGLGDDPRTKRGVEWLLHSQEADGSWYGRWGVNHLYGTGGVVPALRAAGLPASHPAIQRAADWLVAKQNPDGGWGESCYSYDEMSTAGVGVSTASQTAWALLALIAAGRVGDGVTGEAAARGVAWLAETQTAEGTWDEDYFTGTGFAGYFYINYHLYRLVWPVMALGRYQAALAGKGH

SEQ ID NO: 134 - protein, 764 aa, Frankia sp. EuI1c
MSLTSDPSPATPATQPTSARPGSLSDRRSRSGGSAVAGPVLVTTRPVAPVAKSGAVTPTATSGAVTSTATSGPALLPDLATDLADPTGPLAGAASATVRAAGGAGTRTQQTGQLGSTELAGPQADQVADRAAAVLGRARDHLLGLQSEAGWWKGELETNVTMDAEDLMLRQFLGILPPELAAETGRWIRSKQQDDGGWPTFHGGPSDLSTTFEAYVGLRLAGDLPDAPHMLAAASFVRAHGGLAATRVFTRIWMALFGEWPWDEVPVLPPELVLLPSWVPLNVYDFGCWARQTVVALTIVGHFRPVRSLGFSIDELRVAAVRPDRAPLVSWTGVFQRLDAGLRRYQRHPVKTLRELALRRATEWVLARQEADGGWGGIQPPWVYSIMALHLMGYSMDHPVLVAALDGLETFTVREQVREGDEVVTVRRLEACQSPVWDTALAVVALADAGLDARHPAMRKAGEWLVREEVTVPGDWRVRRPNLEPGGWAFEFANDIYPDVDDTAEVVLAVRRLLGSGWDDVDPTFAKQARASVERAVNWSVGMRSANGAWGAFDADNVRELATKIPFCDFGEVIDPPSADVTAHMVEMLADLGRADHPVTQRAVRWLLDDQEPGGSWFGRWGVNHVYGTGAVVPALISAGVAADHPAIRSAVRWLVAHQHPDGGWGEDLRSYQDDAWVGRGEPTASQTAWALLALLAADPMNEAVGRGVRWLCDTQLPNGTWDEPYYTGTGFPWDFSINYHLYRLVFPLTALGRYVTLTGRSAA

SEQ ID NO: 135 - protein, 612 aa, Gemmata obscuriglobus
MIPAERLRTAYRTARAALLAERVPEGHWVGELSTSALSTATAVMALHLVNPFTHRELIDAGRKWLAEHQNADGGWGDTVKSFSNISTTMLCRAAFKLAGEKEYPETVQRVEEYLSRNAGALPTARAAAIRARYGKDHTFSVPILMTCAVAKLVPWDEVPRLPFELACLPQSWYRFAKLPVVSYALPALIAIGQCIHHHRRSQNPIRNTVRRLARGLSLKVLRRIQPTSGGYLEATPLTSFVVMALSSIRRRRAAAEQQVIDEGVRFLVASVRPDGSWPIDTNLATWVTTLSVNALATAGDLEALDTKEQILAWLLKQQYKERHPYTGADPGGWAWTDLPGGVPDCDDTPGALIALAHLDPKSDPQAVLSGLRWVLRLQNGDGGAPTFCRGWGTLPFDRSGADLTAHSVRSLASWYRVWGAGPPPIEHLRHRLKDLEFPLSGLFWDVARRNPRFVRYLKKQQRSDGSWLPLWFGNQHAPDDINPVYGTARVLAAYRDLELKDAPECRRGIEFLLSVQNADGGWGGAKGCPSSVEETALAVEVLLDLADGDAVQKGVAWLAEAVESDRFRDASPIGFYFAKLWYFEKLYPIIFTVAALGRAVKITSPAPAAESA

SEQ ID NO: 136 - protein, 618 aa, Geobacillus sp.
MVADERSALIDALKRSQSVDGSWRFPFETGISTDAYMIILLRTLGIHDEPLIQALVERIESRQDANGAWKLFADEGDGNVTATVEAYYALLYSGYRKKTDSHMQKAKARILEVGGLERVHLFTKVMLALTGQHSWPRRFPLPLVFFLLPPSFPLNMYDLSVYGRANMVPLLVVAERRYSRKTDNSPDLSDLAASRNDWRLPDTEALWSYVKRSLTGLPAWLHRAAEQRAVRYMLEHIEPDGTLYSYFSSTFLLIFALLALGYPKDDPHIARAVRGLRSLRTEIDGHTHMQYTTASVWNTALASYALQEAGVPPTDRTIEKANRYLLSRQHIRYGDWAVHNPYGVPGGWGFSDVNTMNPDVDDTTAALRAIRRAAAKETAFRHAWDRANRWLFSMQNDDGGFAAFEKNVGKRFWRYLPIEGAEFLLMDPSTADLTGRTLEYFGTFAGLTKDHSAIARAIDWLLDHQEADGSWYGRWGICYVYGTWAAVTGLSAVGVPIDHPAMQKAVRWLLSIQNDDGGWGESCKSDGAKTYVPLGASTPVHTAWALDALIAAAERPTPEMKAGVRALVRMLHHPDWTASYPVGQGMAGAFYIHYHGYRYIFPLLALAHYEQKFGPFVD

SEQ ID NO: 137 - protein, 617 aa, Geobacillus sp.
MAGERSALITALKRSQAADGSWRFPFETGISTDAYMIILLRTLDINDEPLIQALVERIESRQEANGAWKLFADEGDGNVTATVEAYYALLYSGYRQPTDRHMQKAKRRILDMGGLDRVHLFTKVMLALTGQYPWPGRFPLPLEFFLLPPSFPLNMYDLSVYGRANMIPLLIAADSRYSRKTDKSPDLSDLFASRGDWGMPESRSLLTYVKRSLIGLPAQLHQAAKQRAVRYLFEHIEPDGTLYSYFSSTFLFIFALLALGYRNDDPRIRQAVRGLRSLRTTIDGHVHLQYTTASVWNTALASYTLQEAGVPMTDRAIEKANRYLLSRQNVRYGDWAVHNPYSTPGGWGFSDVNTMNPDVDDTTAALRAIRQAAAKETAFRHAWDRANQWLFSMQNDDGGFAAFEKNVSSRFWRYLPIEGAEFLLMDPSTADLTGRTLEYFGTFAGLTKDQRAVSRAVDWLLSHQERNGSWYGRWGICYIYGTWAAITGLTAVGVPAHHPALQKAVRWLLSIQNDDGGWGESCKSDGAKTYVPLGDSTPVHTAWALDALVAAAERPTLEMKAGFRALFRLLHHPDWTASYPVGQGMAGAFYIHYHSYRYIFPLLALAHYEQKFGPLDD

SEQ ID NO: 138 - protein, 618 aa, Geobacillus sp. Y412MC52; identical to SEQ ID NO: 136

SEQ ID NO: 139 - protein, 618 aa, Geobacillus sp. Y412MC61; identical to SEQ ID NO: 136

SEQ ID NO: 140 - protein, 617 aa, Geobacillus thermodenitrificans; identical to SEQ ID NO: 137

SEQ ID NO: 141 - protein, 680 aa, Geobacter bemidjiensis
MTSPFKHPISNALTSFNGNVAEPEQSVEQQSGAKVHHLPASIWKRKMGRAKSPLDVAIEGSRDFFFQEQLPKGYWWAELESNVTITAEYIMLFHFLGLVDPERQRKMSTYLLSKQTEEGFWTIYYGGPGDLSTTIEAYFALKLSGYPEDHPALAKARAFILEQGGVVKSRVFTKIFLALFGEFDWQGIPSMPVELNLLPDWAYINIYEFSSWARATIVPLSVVMHSRPVRRVPPSARVQELFVRQPTAADYSFAKNDGLFTWEKFFLGLDRVLKVYEKSPLRPFKKTALAKAEEWVLEHQEPTGDWGGIQPAMLNAILALNVLGYRNDHPAVEQGLRALANFCIETEDQLVLQSCVSPVWDTALALKALLDAGVPPDHPSLVKGAQWLLDKEVTRAGDWRVKSPNLEAGGWAFEFLNDWYPDVDDSGFVMIALKGIQVKDHKAMDAAIKRGINWCLGMQSKNGGWGAFDKDNTKHVLNKIPFADLEALIDPPTADLTGRMLELMGTFDYPVTFPAAQRAIEFLKKNQEPEGPWWGRWGVNYLYGTWSVLCGLAAIGEDMDQPYIRKAVNWIKSRQNIDGGWGETCQSYHDRTLAGVGESTPSQTGWALLSLLAAGEMHSATVVRGVQYLISTQNSDGTWDEQQYTGTGFPKYFMIKYHIYRNCFPLMALGTYRTLTRTQP

SEQ ID NO: 142 - protein, 684 aa, Geobacter lovleyi
MKSRKYPISHALTSFNHTTVAPVEAPAPISVKSPAKVHRLPSSIWKKMEGSAGNPLDKAVELTRDFFFREQLPDGYWWAELESNVTITAEYIMLFHFLGMVDKDKERKMANYLLRQQTEEGYWTVWHNGPGDLSTTIEAYFALKLAGYHADHIALRKARDFILANGGILKSRVFTKTFLAMFGEFSWLGVPSMPIELMLLPDWAYLNVYEFSSWARATIIPMSVLMANRPVYKLPPHARVQELYVRPPRPTDYTFTKEDGIFSLKNFFIGVDHLLKIYESSPIRPFKKRATEKVEQWILEHQEKTGDWGGIQPAMLNAILALHCLGYANDHPAVAKGLEALANFTIEDSDSLVLQSCISPVWDTALVLQAMQEASVPLDHPSLIKASQWLLDREVRIKGDWKIKSPDLEPGGWAFEFQNDWYPDVDDSTAVMIAIKDIKVKNTKARQDAIRRGIDWCLGMQSENGGWAAFDKDNTKHMLNKIPFADLEALIDPPTADLTGRMLELMGNFGYTKDHPQAVSALEFLKNEQEPEGPWFGRWGVNYIYGTWYVLIGLEAIGEDMNSPYIKKSVNWIKSRQNLDGGWGEVCDSYWDRTLMGCGPSTASQTSWALMALMAAGEVGCQAVERGIQYLLATQNSDGTWDEEAFTGTGFPKYFMIKYHIYRNCFPLTALGRYRRLTAGTHAQ

SEQ ID NO: 143 - protein, 730 aa, Geobacter metallireducens
MAKGILNKFAVIAGNKNAGLTAEEECTVVAPIKEVSGKAVHCRQAVKMAEEYLLALQNPEGYWVFELEADVTIPSEYIMLQRFLGREISPELRMRLENYLLDRQLPDGGWPLYAVDGFANISATVKAYLALKVLGHSPQAPHMIRARIMVLSLGGAARCNVFTRILLALFGQLPWHTPPAMPVEIVLLPQRFFFHLSKVSYWSRTVIVPMLLLYAKQPVCRLRPEEGIPELFNTPPDKLRNLDGFQSGRWRKNAFIIIDRLLKRFNRFIPSAIHRKAMAEAEHWTRSRMQGSGGIGAIFPAMAYAVMALRVLGCREDDPDYVRGMQAIDDLLQHRTPQEADSPRTGGPCIDSGTSAAFAFDPSPHAAADGRGNSSICQPCNSPIWDTCLSLSALMEAGMPASHPAAKQAVEWLLSQQIFSPGDWSLKAPDLEGGGWAFQFENTLYPDLDDTSKVIMSLLRAGALENGLYRDRVARGVNWVLGMQSSDGGWAAFDIDNNYHYLNDIPFADHGALLDPSTSDLTGRCIELLSMVGFDRTFPPIAQGIGFLRSKQEGSGAWFGRWGVNYIYGTWSVLSGLRQAGEDMQQPYIRRAVGWLTSCQNHDGGWGETCYSYDDPSLAGQGESTPSQTAWSLLGLMAAGDVHSLAVRRGVRYLLDHQNQWGTWEEKHFTGTGFPRVFYLRYHGYRHYFPLWALGVYSRLSSGQKTRQEERRHSSPGDLHLPWLERIGRR

SEQ ID NO: 144 - protein, 679 aa, Geobacter metallireducens
MKISKHPISHALTSFNETAKETKEEPQKKRGGKVHHLPASIWKKRDVETTSPLDQAIKRSQEFFLREQLPAGYWWAELESNVTITAEYVILFHFMGLVNRDKDRKMATYLLSKQTEEGCWCIWHGGPGDLSTTIEAYFALKLAGYPADHPAMQKARTFILGKGGILKARVFTKIFLALFGEFSWLGVPSMPIEMMLLPNGFTFNLYEFSSWSRATIIPLSIVMAERPVRKLPPWARVQELYVRPPRPMDYTFTKEDGILTWKNIFIGIDHILKVYEASPIRPGMKKAMAIAEQWVLDHQEPTGDWGGIQPAMLNSVLALHCLGYANDHPAVAKGLQALANFCIESDDEIVLQSCISPVWDTALALMAMVDSEVPTDHPALVKAAQWLLDREVRKVGDWKIKAPNLEPGGWAFEFQNDWYPDVDDSGIVMMAIKDVKVKDSKAKAEAIQRGIAWCIGMQSKNGGWGAFDKDNTKHILNKIPFADLEALIDPPTADLTGRMLELMGTFGYPKDHPAAVRALQFVKENQEPDGPWWGRWGVNYIYGTWSVLCGLKAYGEDMGQPYVRKAVEWLAAHQNPDGGWGECCESYCDQKLAGTGPSTASQTGWALLSMLAAGDVDHPAVARGIRYLIETQQPDGTWDEDQFTGTGFPKYFMIKYHIYRNCFPLMAMGRYRALKGHKG

SEQ ID NO: 145 - protein, 714 aa, Geobacter sp.
MNKHKGTFSVIEGGKTTQARGSETCAIMDAADLEKVTSVAASQLAGQQQDDGHWVFDLEADVTIPAEYVMLQRFIGREIDPEISERLAAYMQERQLPDGGWPLYAVDGNVNISASVKAYFALKLLGHDKNAPHMVRARQLILSLGGAAKCNVFTRITLATFGQIPWHTAPAMPIEIMLLPRWFFFHLNKVAYWSRTVIVPLLILYATQPICRLQYNEGITELFTTPPDMLVHLDKFRHHAWRKNVFIALDRVLKRTMHLVPGRIKQHALAEAERWTRARMQGDGGIGAIYPAMANAVMALKTLGCSDDDADYLRGLEAVDNLMVHRNLKTGTIPMDDDSGGIAIDNSSAAPELSPTYLTDTAGNTEFSFCQPCNSPIWDTCMSLSALCESGYAENNSGVTDRAIKWLFSQQIATPGDWSEKCPGLESGGWAFQYENSRYPDVDDTAKVLMSLFRAGALEKPEYREKIERAIRWVQGMQSTDGGWGAFDVDNDYFYLNDIPFADHGALLDPSTADLTGRCIEMMGMLGHGPDYPPIARGIAYLKKEQEPFGGWFGRWGVNYIYGTWSVLSGLHQAGENMDAPYVRKAVEWLISCQNSDGGWGETCASYDDPSLAGSGASTASQTSWALMALMAAGEWRHSAVRNGVRYLTESYCNGWNEKQFTGTGFPRVFYLRYHGYSLFFPVWALAVYSRYINGTATVQEKVREKQFRQCLMV

SEQ ID NO: 146 - protein, 680 aa, Geobacter sp.
MTSPFKHPISNALTSFNGNFAEPEQCVEQQTGAKVHHLPASIWKRKMGKAKSPLDVAIEGSRDFFFQEQLPKGYWWAELESNVTITAEYIMLFHFLGLVDRERQRKMSNYLLSKQTEEGFWPIYYGGPGDLSTTIEAYFALKLSGYPADHPALAKARAFILEQGGVVKSRVFTKIFLALFGEFEWQGVPSMPVELNLLPDWAYINIYEFSSWARATIVPLSVVMHSRPVRRVPPSARVQELFVRQPTAADYSFAKNDGIFTWENFFLGLDRVLKVYEKSPLRPFKNMALAKAEEWVLEHQEPTGDWGGIQPAMLNAVLALNVLGYQNDHPAVEQGLRALANFCIETEDQLVLQSCVSPVWDTALALKALLDAGVPPDHPSLVKGAQWLLDKEVTRPGDWRVKSPALEPGGWAFEFLNDWYPDVDDSGFVMIALKGIQVKDRKSMDAAIKRGINWCLGMQSKNGGWGAFDKDNTRHVLNKIPFADLEALIDPPTADLTGRMLELMGTFNYPITLPAAQRAIEFLKKNQEPEGPWWGRWGVNYLYGTWSVLCGLAAIGEDMDQPYIRKAVNWIKSRQNIDGGWGETCQSYHDRTLAGVGESTPSQTGWALLGLLAAGEMHSATVVRGVQYLISTQNSDGTWDEQQYTGTGFPKYFMIKYHIYRNCFPLMALGTYRTLTRTQP

SEQ ID NO: 147 - protein, 688 aa, Geobacter sp.
MSPCKHPISHALTSFNGETADSVPVQTPKTGAKIHHLPPSIWKKKEGELKSPLDIAIENSRDFFFREQLPDGYWWAELESNCTITAEYVMLYHFMDLVDRERERKMANYLLSKQTEEGFWTIYYGGPGDLSTTVEAYFALKLAGYPADHPAMVKARAFILDNGGIIKTRVFTKIFLALFGEFAWFGVPSMPIELILLPNWAYFNMYELSSWSRATIIPLSIVMTQRPVRKLPPASRVQELYVRPPSPIDYTFTKEDGIFTWKNFFIGVDHILKVYESNPIRPFKKKAMLAAENWVLEHQEATGDWGGIQPAMLNSVLALHCLGYANNHPAVAKGLEALENFCIESEDSLVLQSCISPVWDTALALKALVDSDVPNDHPALVKAAQWLLDKEIRKAGDWKVKSPELEPGGWAFEFLNDWYPDVDDSGFVMMALKDVAVKDRKSMDTAIKRGISWCLGMQSKNGGWGAFDKDNTKYLLNKIPFADLEALIDPPTVDLTGRMMELMGTFGYAKDYPPAVRALDFIKRNQEPDGSWWGRWGVNYIYGTWSVLCGLSAMGEDLNQPYIRKAINWLKSRQNIDGGWGETCESYHDSSLAGIGASTASQTGWALLALMAVGEENASAVARGVQYLLATQKSDGTWDEDLYTGTGFPKFFMIKYHIYRNCFPLTALGTYRRKTGGRAEMQVSEHNK

SEQ ID NO: 148 - protein, 680 aa, Geobacter sp. M18
MTSPFKHPISHALTSFNGIVTEPEQSVEQKAGAKVHQFPASLWKSKPGKAKSPLDIAIEGCRDFFFREQLPKGYWWAELESNVTITAEYIMLFNFLSLVDHERQRKMSNYLLSKQTEEGFWTIYYGGPGDLSTTVEAYFALKLTGYPADHPAMVKARAFILEKGGVIKSRVFTKIFLALFGEFDWLGVPSMPVELNLLPNWAYVNVYEFSSWARATIIPLSIVMLKRPVHKLPPSQRVQELFVRPPRAIDYTFTKEDGIFTWKNFFIGLDHMLKVYERSPVRPFKKRAMGKAEEWVLEHQEETGDWGGIQPAMLNAVLALSALGYDNGHPAVAHGLKALENFCIESDEQIVLQSCISPVWDTALALKALVDAGVPSDHPSLVKGAQWLLEREVRRPGDWRVKSPDLEPGGWAFEFLNDWYPDVDDSGFVMIALKGVEVKDRKAMNAAVKRGIDWCLGMQSKNGGWGAFDKDNTRHILNKIPFADLEALIDPPTADLTGRMLELMGTFGYAKTYPAAQRALKFLKENQEPEGPWWGRWGVNYLYGTWSVLCGLAAIGEDLEQPYIKKAVNWIKSRQNMDGGWGETCESYHDPTLAGMGESTASQTGWALLGLMAAGEVHSATVVRGVQYLISTQSQDGTWDETQYTGTGFPKYFMIKYHIYRNCFPLMALGTYRTLTGGTA

SEQ ID NO: 149 - protein, 680 aa, Geobacter sp. M21; identical to SEQ ID NO: 146

SEQ ID NO: 150 - protein, 730 aa, Geobacter sulfurreducens
MAKGILNKFAVIAGTKKAGPPAGEERTVIAPIKEISGKAVHCSQAVKKAEEYLLALQNPEGYWVFELEADVTIPSEYIMLQRFLGREISPELGKRLENYLLDRQLPDGGWPLYAEDGFANISATVKAYLALKVLGHSPQAPHMIRARLMVLSLGGAARCNVFTRILLALFGQIPWHTPPAMPVEIVLLPQWFFFHLSKVSYWSRTVIVPLLLLYAKQPVCRLRPEEGIPELFSTPPDKLRHLDGFQPGYWRKNAFIIFDRLLKRFNRFIPSALHRKAIAEAEQWTRSHMQGSGGIGAIFPAMAYAVMALRVLGCGEGDPDYIRGLQAIDDLLQHRTPQEADPPRTDGTCIDSGMSAAFALTPSAHAAADGTGSSSICQPCNSPIWDTCLSLSALMEAGMPASHPAATQAVEWLLSQQILSPGDWSLKVPDLEGGGWAFQFENTLYPDLDDTSKVIMSLLRAGALENERYRDRIARGVNWVLGMQSSDGGWAAFDIDNNYHYLNDIPFADHGALLDPSTSDLTGRCIELLSMVGFDRTFPPIARGIGFLRSEQEENGAWFGRWGVNYIYGTWSVLSGLRQAGEDMQQPYIRKAVGWLASCQNHDGGWGETCYSYDDPSLAGKGASTPSQTAWSLLGLMAAGEVNSLAVRRGVRYLLDHQNQWGTWEEKHFTGTGFPRVFYLRYHGYRHFFPLWALGVYSRLSSGQKACQDERRHASPGDLHLPWLERIKKR

SEQ ID NO: 151 - protein, 679 aa, Geobacter sulfurreducens
MKISKNPISHALTSFNDAARETADNSAARKSGKIHHLPATIWKKKESTVSSPLDIAIERTQEFFFREQLPAGYWWAELESNATITAEYIMLFHFMGLVNREKERKMANYLLRQQTTEGYWTIWHGGPGDLSTTIEAYFALKLAGYPADHPSMSKARAFILEHGGILKARVFTKIFLALFGEFSWLGVPSMPIEMMLLPAGFTFNMYEFSSWSRATIIPLSIVMAERPVRKLPPWARVQELYVRPPRPTDYTFTKEDGILTWKNIFIGIDHVLKVYEASPIRPGRKKAMAIAEKWVLEHQEPTGDWGGIQPAMLNSVLALHVLGYANDHPAVAKGLQALANFCIEGEDELVLQSCVSPVWDTALGLMAMVDSGVPTDHPSLSKAAQWLLDREVRRPGDWKIKCPDLEPGGWAFEFMNDWYPDVDDSGIVMMAIKNVKVKDQRAKEDTITRGIAWCLGMQSKNGGWGAFDKDNTKHILNKIPFADLEALIDPPTADLTGRMLELMGTYGYPKDHPAAVRALKFIRETQEPDGPWWGRWGVNYIYGTWSVMSGLAAFGEDMSQPWIRKAVDWLVEHQNEDGGWGECCESYADPRLAGVGPSTASQTGWALLTLLAAGEVASSSVVRGVQYLLDTQKPDGTWDEDAFTGTGFPKFFMIKYHIYRNCFPLMALGRYRTLAGKGL

SEQ ID NO: 152 - protein, 679 aa, Geobacter uraniireducens
MNSCKHPISHALTSFNGETADAAKKQPVKPGAKIHHLPASIWKKKEGESKSPLDIAIENSRDFFFREQLPDGYWWAELESNCTITAEYLMLYHFMGIVDQERERKMATYLLSKQTAEGFWTIYFGGPGDLSTTVEAYFALKLAGYPADHPAMAKARAFILDNGGIIKCRVFTKIFLALFGEFAWFGVPSMPIELILLPNWAYFNMYELSSWSRATIIPLSIVMTERPVRKLPPSSRVQELYVRPPRPIDYTFSKEDGIITWKNFFIGVDHILKVYESNPIRPFKKRALATAENWVLDHQESTGDWGGIQPAMLNSVLALHCLGYANDHPAVAKGLEALANFCIETEDSLVLQSCISPIWDTALALKALVDSDVPTDHPALVKAAQWLLDKEVRKPGDWKIKCPELESGGWAFEFLNDWYPDVDDSGFVMMALKDVAVKDRKSMDGAIKRGINWCLGMQSKNGGWGAFDKDNTKYLLNKIPFADLEALIDPPTADLTGRMLELMGTFGYSKDYPAAVRALEFIKKNQEPEGSWWGRWGVNYIYGTWSVLGGLAAIGEDLNQPYIRKAVNWLKSRQNMDGGWGETCESYHDTSLAGIGESTPSQTGWALLSLMSAGEANSSTVARGIQYLIANQKSDGTWDEEQYTGTGFPKFFMIKYHIYRNCFPLTALGTYRKLTGGMA

SEQ ID NO: 153 - protein, 637 aa, Gloeobacter violaceus
MQVQPRIEKKHLDSAIEASQAYLLARQYSPGYWWAELESNVSMTAEVVLLHKIWRTDTGRPLAKATAHLLAEQRAHGGWELFYGDGGDLNTSIEAYMALKLLGLTADHPALARARAFILAKGGISRARIFTKIHLALIGCYDWRGVPSIPPWVMLLPEAFPVNIYEMSSWARGSTVPLLIVFDRKPVFAVEPAITLDELFVEGRAQARFDLPRSSSDWWANLFVDLDWGFKLAESLGAVPLREEGLKAAERWVLERQEATGDWGGIIPAMLNSLLALRCLDYDPHDPVVERGMAAVDRFAIETESTYRLQPCVSPVWDTALTMRALVDSGLPPDHPALAAAGTWLLKKQILDYGDWAVKNRTGPPGGWAFEFDNRFYPDVDDTAVVVMALDAVRLADETAKGQAIARAVCWVASMQCRGGGWAAFDIDNDAHWLNSLPYADLKAMIDPNTADVTARVLEMYGRCRLIPAAAGAQRALDYLRRTQEPEGCWFGRWGVNYLYGTSGVLSALAAFAPAERTAIERAAAWLRGCQNTDGGWGETCGSYVDRTLMGQGPSTASQTAWALLGLIDASRVARFSDSSALERGLAYLVETQKADGSWDEPYFTGTGFPGHFYLKYHLYQQHFPLSALGRYRRLLS

SEQ ID NO: 154 - protein, 663 aa, Gluconacetobacter diazotrophicus
MMANATDTIELPPSRAADRIVPMTDIDQAVDAAHAALGRRQQDDGHWVFELEADATIPAEYVLLEHYLDRIDPALEERIGVYLRRIQGDHGGWPLYHGGKFDVSATVKAYFALKAIGDDIDAPHMARARAAILDHGGAERSNVFTRFQLALFGEVPWHATPVMPVELMLLPRKALFSVWNMSYWSRTVIAPLLVLAALRPRAINPRDVHVPELFVTPPDQVRDWIRGPYRSQLGRLFKYVDIALRPAERLIPDATRQRAIKAAVDFIEPRLNGEDGLGAIYPAMANTVMMYRALGVPDSDPRAATAWEAVRRLLVELDGEAYCQPCVSPIWDTGLAGHAMIEAASGPEGIRPEDTKKKLAAAAEWLRERQILNVKGDWAINCPDVPPGGWAFQYNNDYYPDVDDTAVVGMLLHREGDPANDEALERARQWIIGMQSSNGGWGAFDIDNNLDFLNHIPFADHGALLDPPTADVTARCISFLAQLGHPEDRPVIERGIAYLRTDQEREGCWFGRWGTNYIYGTWSVLCAYNAAGVAHDDPSVVRAVDWLRSVQREDGGWGEDCASYEGATPGIYTESLPSQTAWAVLGLMAVGLRDDPAVMRGMAYLTRTQKDDGEWDEEPYNAVGFPKVFYLRYHGYRQFFPLLALSRYRNLASSNSRHVAFGF

SEQ ID NO: 155 - protein, 663 aa, Gluconacetobacter diazotrophicus
MMANATDTIELPPSRAADRIVPMTDIDQAVDAAHAALGRRQQDDGHWVFELEADATIPAEYVLLEHYLDRIDPALEERIGVYLRRIQGDHGGWPLYHGGKFDVSATVKAYFALKAIGDDIDAPHMARARAAILDHGGAERSNVFTRFQLALFGEVPWHATPVMPVELMLLPRKALFSVWNMSYWSRTVIAPLLVLAALRPRAINPRDVHVPELFVTPPDQVRDWIRGPYRSQLGRLFKYVDIALRPAERLIPDATRQRAIKAAVDFIEPRLNGEDGLGAIYPAMANTVMMYRALGVPDSDPRAATAWEAVRRLLVELDGEAYCQPCVSPIWDTGLAGHAMIEAASGPKGIRPEDTKKKLAAAAEWLRERQILNGEGRLGDQLPRRAPRRLGLPVQQRLLPRRGRHGSGRHVLHREGDPANDEALERARQWIIGMQSSNGGWGAFDIDNNLDFLNHIPFADHGALLDPPTADVTARCISFLAQLGHPEDRPVIERGIAYLRTDQEREGCWFGRWGTNYIYGTWSVLCAYNAAGVAHDDPSVVRAVDWLRSVQREDGGWGEDCASYEGATPGIYTESLPSQTAWAVLGLMAVGLRDDPAVMRGMAYLTRTQKDDGEWDEEPYNAVGFPKVFYLRYHGYRQFFPLLALSRYRNLASSNSRHVAFGF

SEQ ID NO: 156 - protein, 664 aa, Gluconobacter oxydans
MLIYSDILEKEDRVSETLSRQSVEPDEINHAIEGAQAALGGKQKSDGHWVYELEADATIPAEYVLLEHYLDRIDPEKQAKIGVYLRRIQGHHGGWPLYHDGGFDLSATVKAYFALKAIGDDINAPHMRIAREAILDHGGAARTNVFTRIQLALFGEVPWDATPVMPVELMLLPRKAFFSVWNMSYWSRAVIAPLLVLNALRPKAINPRGIHVQELFVKPPSEVKDWIRGPYRSVWGRFFKHLDSALRPVLPLIPRSVHKKALKAASDFIEPRLSRGGLGAIYPAMANVVMMYRAQGVPDSDPRAKTAWDAIQDLLVDHGDEIYCQPCVSPVWDTGLSGLAMIEAASGPAGTKTKETLAALKKSAEWLREHQILDVKGDWAINAPDLRPGGWAFQYENDYYPDVDDTAVVAMLLHRVDPENSREAISRAREWIIGMQSTNGGWGAFDIDNDHELLNHIPFSDHGALLDPPTADVSARCISFLAQLGDPDDRPVILKAIEYLRSEQEPEGCWFGRWGTNYIYGTWSVLCALNIAGVPHDDPMVLRAVNWLESVQRPDGGWGEDCATYEGGTAGTYKKSLPSQTAWAVLALMAVGRRESEAVKRGVAYLVSQQNEKGEWQEEAYNAVGFPKVFYLRYHGYKQFFPLTALARYRNLGVSNSGKVEYGF

SEQ ID NO: 157 - protein, 651 aa, Granulibacter bethesdensis
MPKDIPADLASEAISGDMLEQAVLRASMALHRKQQTDGHWVFELEADATIPAEYVLLEHFLDRIDDDLERKIGVYLRRIQGDHGGWPLFHEGAFNLSASVKAYYALKAIGDDPDAPHMRRAREAILAAGGAERSNVFTRIQLALFGQIPWRGVPVMPAELMIAPKWFPINMWKVSYWSRTVIAPLLVLMDRKPKARNPRNVHVRELFLHDPDRIRDWIRGPFRSGWGHFFKYLDSVLRVVEPVALKPMRPRSIRLAVDFVRERLNGEDGLGAIYPAMANSVMMYDVLGYSPDHPEAAIAWESVRKLLVIKEDEAYCQPCLSPIWDTGLSGHAMAEAEGAVSPGVAAACDWLRNRQITDVVGDWAEIRPGVQPGGWAFQYNNAHYPDVDDTAVVAMLLHRQGDPAHEESIRKAREWIIGLQCRDGGWGAFDADNDKDYLNHIPFADHGALLDPPTADVTARCISFLAQLGNPEDKPVIDRAMAWLRKEQEADGSWFGRWGTNYIYGTWSVLCAMNVAGMPHDDPAIRRAVNFLVATQREDGGWGEDEETYDPASGAQPGRYKESTPSQTAWALIGLMAAGEAEHEATRRGIAYLQATQKPDGEWDEAAYTAVGFPRVFYLKYHGYRQFFPLMALSRYKNLRSSNMKKVSFGF

SEQ ID NO: 158 - protein, 665 aa, Hyphomicrobium denitrificans
MTTNAAATSARSGEDAIRQVSGQQLETAIASARNSLLALQRPDGHFVFELEADATIPAEYVLMRHYLAEPVDAVLEEKIARYLRRIQSDDGGWPLFRDGASNISASVKAYYALKMIGDAPNAPHMQKARAWILAQGGASHSNVFTRNLLALFGAIPWSGVPVMPVEIMLLPKWFPFHIDKISYWARTVLIPLTVLNALKPVARNPKGVGIAELFVTPPDQVRNWPKGPHQKFPWSQVFGGIDRVLRLFEPAFPKSLRKKSIDKAVAFATERLNGEDGLGGIFPAMVNALLVYDALGYPHDHPDYVTARGSIEKLLVIKDDEAYCQPCLSPVWDTALAVHALMESGVAQADQNVDRALAWLKPLQVLDTVGDWAASRPGVRPGGWAFQYANAYYPDVDDTAVVVMAMDRAAGGDAAKRDHYRESMARGREWVAGVQSKNGGWGAFDADNTYEYLNQIPFSDHGALLDPPTADVSARCVSMLAQLGERRETSPVLDKAMRYLESTQEKDGSWYGRWGMNYIYGTWSVLCALNAAGVAPSAPSMRKAADWLLSIQNSDGGWGEDGESYSLDYKGYEPAPSTASQTAWALMGLMAAGEVDHPAVQRGVAYLAAKQGSDGFWGEERFTATGFPRVFYLRYHGYSKFFPLWALARYRNLNAANSKSVLVGM

SEQ ID NO: 159 - protein, 694 aa, Leptospirillum ferrodiazotrophum
MSGQSNFTGGKKMTPAEGSSSPAPALLEKAAPSIELDERSDPLSRTLARAVSWLVAAQDGAGHWVAPLEADATIPSEYVFLHEVLGRPLDPVRRDKIVRAILSVQGKEGAWPLFHDGDPDISATVKAYQALKLCGFDPSHPALVRAREWVLSQGGAGKVNVFTRIALAIFGQYSWTKIPALPAEMVLLPSWFPFSIYSVSYWSRTVIVPLLFIYHHKPLVRLSPERGISELFDPARPDGESFAPSPDFFSLRNLFLLLDKVLQVWNRHPPGFLRKKALSFAMEWMVPRLKGEGGLGAIYPAMANSAVALSLEGYELDHPLMQRVLASIDDLLIEGEKEVLVQPCVSPVWDTALAMGALIEAGISPDSPTVDRAMEWFCAREVRTRGDWAIRAPDCEPGGWAFQFENDYYPDVDDTAMVLMGMAKILPARPDLAARMEGVFRRATLWVMAMQGTDGGWGAFDRDNDLLFLNHIPFADHGALLDPSTADLTGRVLELLGALGYGPDFPPAARAIRYLRREQEEDGSWFGRWGVNYIYGTWSVVAGLKSIGVPMSEPWVMRSMEFLLARQNPDGGWGEDCLSYASRDFAGRGASTPSQTAWALIALLHGGHAGHMAVRQGVDYLIQQMTPEGTWNEELFTGTGFPRVFYLRYHMYRHYFPLWALALYRNMTERGRALGHERVDFWKTAPYAPIARSV

SEQ ID NO: 160 - protein, 683 aa, Leptospirillum rubarum
MKGKEPTREELLSFSSGIQMDSSAENTTPVSTEELQEKVRLAAESLISRQVEEGYWVEPLEADVTITSEYILLQYLLGRERDEFFRRAAPFILESQGEDGGWPLYHGGPAEISATVKAYLALKLLGYDADHPAMQRARALVLERGGAINVNVFTRITLALFGQYDWKGVPALPPEMILLPRWFPLSIYTVSYWSRTVIVPLLFIYHYKPLLELPPEKGVQELFITPMSEVRVHYAWDKHWVSWKNLFFVLDRILQAWNRHPPSFLRRKALKKAMEWMIPRLKGEGGLGAIYPAMANSVLALRLEGYAMDHPLVRRAIQSIDDLVFDLGEQQSVQPCHSPIWDTALALGALYEAGLDEGSPFVSRALDWFCRKEVRTVGDWSVRVPGVEAGGWAFQFENDYYPDIDDTSVVLMDFAKWVPEMGAYRDVFRRAIEWTLSMQGTDGGWGAFDKDNDFLFLNNIPFADHGALLDPSTSDVTGRVTELLGILGYDARTPVVRRALRFLRKEQEENGSWYGRWGVNYIYGTWSVVSALKAVGEDMSAPYVQKAMQFLFSRQNPDGGWGESCYSYFRKDTAGEGVSTSSQTAWALIALIHGGHVRHPAVSKGIDFLLSRQQADGKWLEQEYTGTGFPKVFYLRYNMYRDYFSLWALSLYRNVLLDGQSRVERLARRWKGNPYPVRSRFLA

SEQ ID NO: 161 - protein, 683 aa, Leptospirillum sp.
MEGKDPTREELLSFTSGIQMDSRVGNTNPVSTEELQEKVRLAAESLISRQGEEGYWVEPLEADITITSEYVLLQYLLGRERDEFFRRAAPFILESQGEDGGWPLYNGGPAEISATVKAYLALKLLGYDADHPAMQRARALVLERGGAINVNVFTRITLALFGQYDWKGVPALPPEMILLPRWFPLSIYTVSYWSRTVIVPLLFIYHYKPLLELPPEKGVQELFITPMSEVRVHYAWDKHWVSWKNLFFVLDRILQAWNRHPPSFLRRKALKKAMEWMIPRLKGEGGLGAIYPAMANSVLALRLEGYEMDHPLVRRAIQSIDDLVFDLGEQQSVQPCHSPIWDTALALGALYEAGLDEGSPFVSRALDWFCRKEVRTVGDWSVRVPGVEAGGWAFQFENDYYPDIDDTSVVLMDFAKWVPEMGAYRDVFRRAIEWTLSMQGTDGGWGAFDKDNDFLFLNNIPFADHGALLDPSTSDVTGRVTELLGILGYDARTPVVRRALRFLRKEQEENGSWYGRWGVNYIYGTWSVVSALKAVGEDMSAPYVQRAMQFLFSRQNPDGGWGESCYSYFRKDTAGEGVSTASQTAWALIALIHGGHVRHPAVSKGIDFLLSRQQADGKWLEQEYTGTGFPKVFYLRYNMYRDYFSLWALSLYRNVLLDGQSRVERLSRRWKGTPYPVRSRFLA

SEQ ID NO: 162 - protein, 683 aa, Magnaporthe grisea
MSPFLQASDDNNPLFKESCQALDHATEFARDTLVNKEHWCGWVLSNVTVTAEWIFLQYILGLEMSNEDRRGFLKHFTSSQRPDGSWSLATQTTTGGELSCTIEAYLALKILGVSPEEDYMVRARDYVRSHGGAEKMRMLSRFHLAMFGLIPWAAVPQMPPELIFMPSWSLVNIYKFSSWARCNIVGLCMLRVHEPLYALPNGKQLDNDYLDELWLDPYHKAIPYTVPYLQLMQTSPLGVLFQLGDLFLWLLSFLGFWFLRRWAVSSSIQWTLDHQEPSGDWGGIYPPMHHNILALMLEGWSQDDPVIQRGIGACQRFLAEDPAHGKWMQPSVSPVWDTFLMIRAVADAKTTDDADKLLVKPVDWVLAQQIDDDHIGDWRIYRPDIPAGGFAFEYFNKWYPDVDDTAVGVVALMRHDPSLVNDDRILKAAAWTLGMQNRDFGWAAFDADNNAFYLHATPFSDMDSLTDSSTPDVTGHVLEMLGLMYRLERQGRVKSPEMLAFLSQSHGACDRGLGYLLGSQEAFGGWYGRWGVNYIFGTSAALCALAYFADRKGVRGKMAAGADWLRSRQNPDGGWGELLESYDNKALAGRGRSTPSQTAWALQGLLELEDPRGEVVEAGVNWLLRHQVTSPSRNSGRVSATWPEDDYTATGFPGHFYLKYELYCHYFPMMALARYRSCIQDGA

SEQ ID NO: 163 - protein, 667 aa, Magnetospirillum magnetotacticum
MREAAVSKVETLQRPKTRDVSLDDVERGVQSAARALTDMTQADGHICFELEADATIPSEYILFHHFRGTEPRAGLEAKIGNYLRRTQSKVHGGWALVHDGPFDMSASVKAYFALKMIGDDIEAPHMRAVRKAILQRGGAANANVFTRILLALYGEVPWTAVPVMPVEVMHLPKWFPFHLDKVSYWARCTMVPLFVIQAKKPRAKNPRGVGVAELFVTPPDSVRTWPGSPHATWPWTPIFGAIDRVLQKTQDHFPKVPRQRAIDKAVAWVSERLNGEDGLGAIFPSMVNSVLMYEVLGYPPDHPQVKIALEAIEKLVAEKDDEAYVQPCLSPVWDTALTSHAMLEVGGTQAEANARAGLDWLKPLQILDIKGDWAETKPNVRPGGWAFQYANPHYPDLDDTAVVVMAMDRAQRQHGLVSGMPDYSTSIARAREWVEGLQSADGGWAAFDADNNHHYLNHIPFSDHGALLDPPTADVTARVVSMLAQLGETRETSRALDRGVTYLLNDQEKDGSWYGRWGMNFIYGTWSVLCALNAAGVDPQSPEIRKAVAWLIRIQNPDGGWGEDASSYKLNPEFEPGYSTASQTAWALLALMAVGEVDDPAVARGVNYLMRTQGADGLWNEERYTATGFPRVFYLRYHGYPKFFPLWAMARFRNLKRGNSRQVQFGM

SEQ ID NO: 164 - protein, 691 aa, Methylacidiphilum infernorum
MHSGRVFLEKENREENRATFHSSPLILVEESLNLPKKVEETIKKAQRYLLSIQKEDGHWVGELFVDVTLACDCIHLMHWRGKIDYKKQLRLVKHIVDRQLPDGGWNIYPGGPSEVNATVKAYFALKLAGFSPDDPLMAKARSTILRLGGIPKCMTYTKLGLALLGVYPWDRLPVIPPEIILFPNWFPFNIYEISAWSRAMLVPLSVIHHFKPTRNLPEKYQLHELFPYGTEHGKFSWLKKGARYLSKQGLFLACDKFLQYWDKTSLKPFRKMALKKAEKWLLERISAGSDGLGAIFPAMHYAIMALIAMGYTEDNPILKKAIADFEGLEVDDKKNDDLRIQPCLSPVWDTAVGLVALAESGVARNAKELKRAAYWLLDREIKIKGDWHVRNPHPEPSGWAFEYNNVYYPDVDDTLMVLLALRLIDIEDKIRKEEVMQRALRWVISFQCKNGGWAAFDKDVYKKWLEDIPFADHNAILDPPCSDITARALELFGKMGIKKTERFVQKAIAYLKETQENDGSWMGRWGVNYIYGTWQALRGLQAIGENMNQEWILRARDWLESCQNEDGGWGETPASYDNPQLKGKGPSTASQTAWAVSGIMACGDIFRPSVSRGIKYLCDRQLSDGSWAEEFLTGTGFPGVFYLKYDMYRNAWPLLVIGEYHRQYLKAKEQVSYWVDGTIGRKVKKERLPEI

SEQ ID NO: 165 - protein, 667 aa, Methylobacterium chloromethanicum
MREAAVSKVETLQRPKTRDVSLDDVERGVQSATRALTEMTQADGHICFELEADATIPSEYILFHQFRGTEPRPGLEAKIGNYLRRTQSKVHGGWALVHDGPFDMSASVKAYFALKMIGDDIEAPHMRAVRKAILQRGGAANANVFTRILLALYGEVPWAAVPVMPVEVMHLPKWFPFHLDKVSYWARCTMVPLFVIQAKKPRAKNPRGVGVAELFVTPPDSVRTWPGSPHATWPWTPIFGGIDRVLQKTQDHFPKVPRQRAIDKAVAWVSERLNGEDGLGAIFPAMVNSVLMYEVLGYPPEHPQVKIALEAIEKLVAEKEDEAYVQPCLSPVWDTALNSHAMLEAGGHQAEANARAGLDWLKPLQILDIKGDWAETKPNVRPGGWAFQYANPHYPDLDDTAVVVMAMDRAQRQHGLVSGMPDYSESIARAREWVEGLQSADGGWAAFDADNNHHYLNHIPFSDHGALLDPPTADVTARVVSMLSQLGETRATSRALDRGVTYLLNDQEKDGSWYGRWGMNFIYGTWSVLCALNTAGVDPQSPEIRKAVAWLIRIQNPDGGWGEDASSYKLNPEFEPGYSTASQTAWALLALMAAGEVDDPAVARGVNYLVRTQGQDGLWSEERYTATGFPRVFYLRYHGYPKFFPLWAMARFRNLKRGNSRQVQFGM

SEQ ID NO: 166 - protein, 645 aa, Methylobacterium chloromethanicum
MNTEPRFSAPETLRAIAGAGRALGRHQRRDGHWVFELEADATIPAEYVLLEHYMDRITPERQARIGAYLRRIQGEHGGWPMFHAGEFNISASVKAYCALKAIGDDPQAPHMVRARQAILGHGGAERANVFTRIQLALFGAIPWRGVPVMPVEIMHLPKWFFFNIWAMSYWARTCVVPLLVLQARKPRARNPRQVSFDEIFRTEPDEVRDWIRGPYRSRWGVVFKHIDTVLRWTEPLFSKVARESAIFKAVDFVEERLNGEDGLGAIYPAMAYALMMYDVLGYPEDDPRCVTIWKAIDKLLIETDEEVYCQPCVSPVWDTSLSGHAMIEAARTGGIEAQAELDAACDWLVARQVKDVRGDWAETRPDAEPGGWAFQYRNDHYPDVDDTAVVAMLLHRNGRPEHAEAIEKARRWVVGVQSRNGGWGAFDADNDREFLNHIPFSDHGALLDPPTADVTGRCISFLSQLGHEEDRPVIERALAYLRAEQERDGSWYGRWGTNYVYGTWTVLCGLNAAGIPHDDPMVRRAVDWLVSIQRADGGWGEDERSYDVGHYVENAESLPSQTAWAMLGLMSVGQADHPAVLRGAAYLQRTQGPDGEWQERAYNAVGFPRVFYLKYHGYRLFFPLFALSRLHNLQRGNSREVSFGF

SEQ ID NO: 167 - protein, 667 aa, Methylobacterium extorquens
MREAAVSKVETLQRPKTRDVSLDDVERGVQSATRALTEMTQADGHICFELEADATIPSEYILFHQFRGTEPRPGLEAKIGNYLRRTQSKVHGGWALVHDGPFDMSASVKAYFALKMIGDDIEAPHMRAVRKAILQRGGAANANVFTRILLALYGEVPWVAVPVMPVEVMHLPKWFPFHLDKVSYWARCTMVPLFVIQAKKPRAKNPRGVGVAELFVTPPDSVRTWPGSPHATWPWTPIFGGIDRVLQKTQDHFPKVPRQRAIDKAVAWVSERLNGEDGLGAIFPAMVNSVLMYEVLGYPPEHPQVKIALEAIEKLVAEKEDEAYVQPCLSPVWDTALNSHAMLEAGGHQAEANARAGLDWLKPLQILDIKGDWAETKPNVRPGGWAFQYANPHYPDLDDTAVVVMAMDRAQRQHGLVSGMPDYSESIARAREWVEGLQSADGGWAAFDADNNHHYLNHIPFSDHGALLDPPTADVTARVVSMLSQLGETRATSRALDRGVTYLLNDQEKDGSWYGRWGMNFIYGTWSVLCALNAAGVDPQSPEIRKAVAWLIRIQNPDGGWGEDASSYKLNPEFEPGYSTASQTAWALLALMAAGEVDDPAVARGVNYLVRTQGQDGLWSEERYTATGFPRVFYLRYHGYPKFFPLWAMARFRNLKRGNSRQVQFGM

SEQ ID NO: 168 - protein, 663 aa, Methylobacterium nodulans
MGKVETLHRMSTQDITLDDVERRVSLASKALMRLAGPDGHWCFELEADATIPSEYILYHHFRGSIPSAELEGKIANYLRRTQSAQHDGWSLVHDGPFDMSATVKAYFALKMIGDSIEAPHMRRAREAILRRGGAAHANVFTRTLLALYGEVPWSAVPVMPVEVMLLPRWFPFHLDKVSYWARTVMVPLFVLQAKKPRARNPRGIGIQELFVEPPERVKRWPAGPQESSPWRPVFAAIDKVLQKVEGSFPAGSRARAIDKAVAFVSERLNGEDGLGAIFPAMVNAVLMYEALGYPEDHPLVATARSSVEKLVTVKEHEAYVQPCLSPVWDTALSAHALMEAGGVEAERHAKRALDWLKPLQVLDIKGDWAASKPNVRPGGWAFQYANPHYPDLDDTAVVVMAMDRAQVRRSPGPDAADYGQSIARAREWVEGLQSRDGGWAAFDADNTYHYLNYIPFSDHGALLDPPTADVTARCVSMLAQLGETRESCPPLDRGVAYLLADQEADGSWYGRWGMNYIYGTWSVLCALNAAGVDPASEPVRRAVNWLTTIQNPDGGWGEDAASYKLEYRGYERAPSTASQTAWALLGLMAAGEADSPAVARGINYLTRSQGADGLWTEDRYTATGFPRVFYLRYHGYAKFFPLWALARYRNLQQSNSRRVAVGM

SEQ ID NO: 169 - protein, 667 aa, Methylobacterium populi
MREAAVSKVETLQRPKTRDVSLDDVERGVQNAARALTEMTQTDGHICFELEADATIPSEYILFHQFRGTVPRDGLEAKIGNYLRRTQSKVHGGWALVHDGPFDMSATVKAYFALKMIGDDIEAPHMRAARKAILQRGGAANANVFTRILLALYGEVPWAAVPVMPVEVMHLPKWFPFHLDKVSYWARCTMVPLFVIQAKKPRAKNPRGIGVAELFVTPPDSVRTWPGSPHATWPWTPIFGAIDRVLQKTQDHFPKVPRQRAIDKAVAWVSERLNGEDGLGAIFPSMVNSVLMYEVLGYPPDHPQVKIALEAIEKLVAEKDDEAYVQPCLSPVWDTALTSHAMLETGGAAAEANARAGLDWLKPLQILDIKGDWAETKPNVRPGGWAFQYANPHYPDLDDTAVVVMAMDRAQRQHGLVSGMPDYSASIARAREWVEGLQSADGGWAAFDADNNHHYLNHIPFSDHGALLDPPTADVTARVVSMLSQLGETRETSRALDRGVTYLLNDQEKDGSWYGRWGMNFIYGTWSVLCALNAAGVDPQSPEIRKAVAWLIRIQNPDGGWGEDASSYKLNPEFEPGYSTASQTAWALLALMAVGEVDDPAVARGVNYLMRTQGQDGLWNEERYTATGFPRVFYLRYHGYPKFFPLWAMARFRNLKKGNSRQVQFGM

SEQ ID NO: 170 - protein, 665 aa, Methylobacterium radiotolerans
MREAVSKVEALQRSKTQGISLEDVERGVAQATRALTALAHDDGHICFELEADATIPSEYILFHHFRGTQVPGDLEAKIGNYLRRTQGRHGGWALVHEGPFDMSCTVKAYFALKMIGDDIEAPHMRRAREGILSRGGAANANVFTRFMLALYGEVPWRAVPVMPVEVMFLPKWFPFHLDKISYWARTTVVPLFVLQATKPRARNPRGISVQELFVTPPESVRSWPGSPHATWPWTPIFGFIDRVLQRVENHLPRKSRQRAMEMARAWVSERLNGEDGLGAIFPAMVNSVLMYEVMGYRPDHPQVRVACDAIEKLVVEKADEAYVQPCVSPVWDTALASHALLEAGGPEAEAQARAGLDWLKPRQVLDIVGDWAARKPKVRPGGWAFQYANAHYPDLDDTAVVVMAMDRAMHQHGLVAGMPDYKASIARAREWVEGLQSEDGGWAAFDADNNHMYLNHIPFSDHGALLDPPTADVTARVVGMLSQLGETRETSRALDRGVNYLLNDQEEDGSWYGRWGMNFIYGTWSVLCALNAAGVDPADPRIQKAVSWLIRIQNPDGGWGEDASSYKIDPAFEPGSSTASQTAWALLALMAAGAVDDPAVTRGINFLTRTQGADGFWKEERYTATGFPRVFYLRYHGYPKFFPLWAMARFRNLKRGNSRRVQFGM

SEQ ID NO: 171 - protein, 663 aa, Methylobacterium sp.
MGKVETLHRTSTQDITLDDVERRVTLASKALMRLANADGHWCFELEADATIPSEYILYHHFRGSIPTAELEGKIAAYLRRTQSAQHDGWALIHDGPFDMSATVKAYFALKMVGDPIDAPHMRRARDAILRRGGAAHANVFTRIMLALYGEVPWTAVPVMPVEVMLLPRWFPFHLDKVSYWARTVMVPLFVLQAKKPRARNPRGIGIRELFVEAPERVKRWPAGPQESSPWRPVFAAIDKVLQKVEGFFPAGSRARAIDKAVAFVSERLNGEDGLGAIFPAMVNTVLMFEALGYPDDHPFAVTARSSVEKLVTVKEHEAYVQPCLSPVWDTALAAHALMEAGGTEAERHAKRAMDWLKPLQVLDIKGDWAASKPDVRPGGWAFQYANPHYPDLDDTAVVVMAMDRVQSRRSPGPDAADYGLSIARAREWVEGLQSRDGGWAAFDADNTYHYLNYIPFSDHGALLDPPTADVTARCVSMLSQLGETRETCPPLDRGVAYLLADQEADGSWYGRWGMNYIYGTWSVLCALNAAGIDPACEPVRRAVTWLTAIQNPDGGWGEDASSYKLEYRGYERAPSTASQTAWALLALMAAGEADNPAVARGINYLTRTQGADGLWAEDRYTATGFPRVFYLRYHGYAKFFPLWALARYRNLQRGNSLKVAVGM

SEQ ID NO: 172 - protein, 672 aa, Methylocella silvestris
MDDRVGAATFEAQPRAGFGSVEAAISRAREALLAVQKPDGHFVFELEADVSIPAEYILFRHFLGDPAKTEIERKIGVYLRRRQTAAGGWPLFAEGVFNVSSSVKAYFALKIIGDDPNAPHMAKARNAILAHGGAAQSNVFTRSLLALYGEVPWRAVPAMPVEIMHLPRWFPFHLSKVSYWGRTVIAPLIVVHALKPRAKNPRKISVSELFVAPAETVSRWPGAPHKSFPWTTIFGAIDRVLHKTEPLLPARSHQTAIDKAVAFVTARLNGEDGLGAIYPAMAYSAMMFFALGAPLSDPRIVQIRKAIDRLLVIKDGEAYCQPCVSPVWDTALASHALMESAGQRPEARTAPAAAAVFEALDWLKPLQVLDVKGDWATQNPDVRPGGWAFQYANPHYPDLDDTAVVVLAMDRAVKTSPLIAGEEETAYVEAISRAREWILGLQSANGGFGAFDADNDRDYLNYIPFADHGALLDPPTADVTARCVSMLGQLGERPETSPALARAIDYLLSEQEEEGSWFGRWGMNYIYGTWSVLSAFNAVERPADCAATRKAAAWLKRIQNPDGGWGEDGESYALGYKGYNPAPSTASQTAWALLALMAAGEVDAPEVALGLDYLVSTQADDGFWDEARFTATGFPRVFYLRYHGYAKFFPLWAMARYRNLKSGNRLKTQFGM

SEQ ID NO: 173 - protein, 654 aa, Methylococcus capsulatus
  Misc_feature (591)..(591): Xaa is any naturally occurring amino acid
MLREATAISNLEPPLTASYVESPLDAAIRQAKDRLLSLQHLEGYWVFELEADCTIPAEYILMMHFMDEIDAALQAKIANYLRHHQSADGSYPLFRGGAGDISCTVKVYYALKLAGDSIDAPHMKKAREWILAQGGAARSNVFTRIMLAMFEQIPWRGIPFTPVEIMLLPKWFPFHLDKVSYWSRTVMVPLFILCSHKVTARNPSRIHVRELFTVEPQKERHYFDHVKTPLGKAILALERFGRMLEPLIPKAVRKKATQKAFDWFTARLNGVDGLGAIFPAMVNAYEALDFLGVPPDDERRRLARESIDRLLVFQGDSVYCQPCVSPIWDTALTSLTLQEVARHTADLRLDAALSKGLKWLASKQIDKDAPGDWRVNRAGLEGGGWAFQFGNDYYPDVDDSAVVAHALLGSEDPSFDDNLRRAANWIAGMQSRNGGFGAFDADNTYYYLNSIPFADHGALLDPPTADVSARCAMFLARWVNRQPELRPVLERTIDYLRREQEADGSWFGRWGTNYIYGPGAVLLAYEGRRVPNDDPSVRRAVAWLKSIQREDGGWGEDNFSYHDPSYRGRFHTSTAFQTGFALIALMAAGEXGSPEVQAGVDYLLRQQRPDGFWNDECFTAPGFPRVFYLKYHGYDKFFPLWALARYRNERYALA

SEQ ID NO: 174 - protein, 635 aa, Microcystis aeruginosa
MQIQDKITEIAAKTAKAIELSQNYLLSTQYSEGYWWAELESNVTITSEAILLHKIWKTDKKRPLDKAATYLRQQQCPNGAWELFYGDGGDLSTTVEAYMGLRLLGIPANDPALEKAREFILAKGGISKTRIFTKMHLALIGCYDWQGVPSIPAWIMLLPENFPFTIYEMSSWARGSTVPLLIVFDKKPVYKMGFNLDELYTEGVNNVKYELPKNNNWSDVFLWLDGLFKWAEKTDLVPFRQESLKAAEKWVIERQEDTGDWGGIIPAMLNSLLALKALDYDVYDPIVARGLKAVDNFAIETDNTYCVQPCVSPVWDTAWVIRSLIESGLNPAHPAMIKAGQWLIDQQILDYGDWAIKNKIGTPGGWAFEFDNRWYPDLDDSAVVVMALELIKMPDENIKTSVMKRAVNWMATMQCKAGGWGAFDIDNDQNWLNSLPYADLKAMIDPNTADVTARVLEMLGTCDVKMGENRVKKALDYLEKEQEADGSWFGRWGVNYIYGTSGALSALAFLEPNQYRQQLQKGANWLSSCQNVDGGWGETCFSYNNPKFKGQGNSTASQTAWALIGLLAVGKVTGNYQREVIEKGVNYLLVTQKENGTWDEDYFTGTGFPCHFYLKYHFYQQYFPLLALGRYRALI

SEQ ID NO: 175 - protein, 695 aa, Neosartorya fischeri
MLQTEAITTEGLRFRSLAPDDPLLPRVKQALKLSGQHSREEMHSDGHWCGEVKTNATTSAEHVLLCQALDINLDADREAFISWFRCTQGADGGWSTAPDQAGDISVTVEAYLALKILGLSEDDAAMRSARDFAIAAGGVARVRIFTRIYLAMFGLFPWAAVPELPPELILLPSRVPVSIYHWSAWARATVVPLLIISHHRPIYALPGGKATCSDYLDELWCDPRNKMVPYNHDKPTAWRSDPFALIFTLADSILHRLDGLRSFNPLRRFALRKCVDWILEHQEDMGDIGDIMPPLHGAMLALRLEGYPLHSDPIHRGLEAIERFAYRDQQGKRIQTTVSAFWDTSLMLVALGDAGMASSPWLTRSLGWLQQHQRLGNYGDWKVNNPGLKAGGFSFGYFNTWYPDVDDTASAVLAIIRQDERLVCSASVLDALNWLLGMQNTDGGWGAFDRDNNKLFLNKIPFSDMEAFCDPSTPDVTGHVLEAFGIFLAVSARQQSPTKADVLTDRIVSASRRAICYLSDTHVSSGGWYGRWGCNYIYGTSAVLCALAYFGSKSDTLSGVRSVKDAVNQAIRWLETVQNQDGGWGETVNSYKDPSRAGSGPSTASQTAWAIMALLPYLPPSTEVIQRGVEYLLRTQTKTASQGATWHEKAYTGTGFPKYFYMGYSFYCHYFPMMALGRYAYPCPEWHENWRPKKE

SEQ ID NO: 176 - protein, 654 aa, Nitrobacter hamburgensis
MNSVNATVAPIDDAALGGSIGAATRGLLDLKQPDGHFVFELEADATIPSEYVLLRHYLGEPVDAALEAKIAVYLRRIQGAHGGWPLVHDGPFDMSASVKAYFALKMIGDSIDAPHMARAREAILSRGGAANVNVFTRFLLSLFEVLTWRSAPVLPIEIMLLPMWSPFHINKISYWARTTMVPLMVLAALKPRARNPRGIGIRELFLQDPATVGTPKRAPHQSPAWFTLFNSLDWILRKIEPLFPKRLRARAIEKAIAFVEERLNGEDGLGAIFPPMVNTVMMYDALGFPPEHPPRAVARRGIDKLLVIGKDEAYCQPCVSPIWDTALTCHALLEAGGPEALSGAGKSLDWLLPKQELVLKGDWAVKRPDVRPGGWAFQYANAHYPDLDDTAVVVMAMDRVRRNDRSDKYNEAIARGREWIEGMQSRDGGFAAFDADNLEYYLNNIPFSDHAALLDPPTEDVTARCVSMLAQLGETVRSSPSMAAGVDYLRRTQLKEGSWYGRWGLNYIYGTWSVVCALNAAGVDHQDPAMRKAVDWLVSIQNADGGWGEDAVSYRLDYKGFEGAPTTASQTAWALLALMAAGEVENPAVARGMKYLIDTQTKKGLWDEQRFTATGFPRVFYLRYHGYSRFFPLWALARYRNLRSTNSKVVGVGM

SEQ ID NO: 177 - protein, 651 aa, Nitrobacter sp.
MNATVAQIGDAVLEDRIGSATRGLLNLKQSDGHFVFELEADATIPSEYILLRHYLGEPVDTVLEAKIAAYLRRIQGAHGGWPLVHDGPFDMSASVKAYFALKMIGDSVDAPHMARAREAILSRGGAANVNVFTRFLLSFFEVLTWRSVPVLPVEIMLLPMWSPFHLNKISYWARTTMVPLMVLAVLKPRARNPRDVGIRELFLQDPATVRTPKRAPHQSPAWFALFSSLDWILRRIEPLFPKRLRARAMEKAIAFVEERLNGEDGLGAIFPPMVNTVMMYDALGFPPEHPPRAVTRRGIDKLLVIGEDEAYCQPCVSPIWDTALSCHALLEAGAPEALNSAGKCLDWLLPKQELVLKGDWAAKRPDVRPGGWAFQYANGHYPDLDDTAVVVMAMDRVRRNGRGDKYDEAIERGREWIEGMQSRDGGFAAFDADNLEYYLNNIPFSDHAALLDPPTEDVTARCVSMLAQLGATVDGSSSMAAGVEYLRRTQLAEGSWYGRWGLNYIYGTWSVLCALNAAGVDHQDPAIRKAVDWLLSIQNEDGGWGEDAVSYRLDYKGFEGAPTTASQTAWALLALMAAGEVENPAVTRGIKYLIDTQTKKGLWDEQRYTATGFPRVFYLRYHGYSKFFPLWALARYRNLRSTNSKVVGVGM

SEQ ID NO: 178 - protein, 654 aa, Nitrobacter winogradskyi
MNSINATAAPIDDNVLGDRIGAATRGLLSLKQSDGHFVFELEADATIPSEYILMRHYLGEPVDTVLEAKIAAYLRRIQGAHGGWPLVHDGPFDMSASVKAYFALKMAGDSIDAPHMARAREAILSRGGAANVNVFTRFLLSFFGELTWRSVPVLPVEIMLLPMWSPFHLNKVSYWARTTMVPLMVLAALKPRARNPRGIGIRELFLEDPATVGTPKRAPHQSPGWFALFTGFDRVLRLIEPLSPKWLRARAMKKAIAFVEERLNGEDGLGAIFPPMVNTVMMYDALGFPPEHPPRAVTRRGIDKLLVVGENEAYCQPCVSPIWDTALSCHALLEAGGPEAVNSAGKCLDWLLLKQELVLKGDWAVKRPDVRPGGWAFQYANGHYPDLDDTAVVVMAMDRVRRNGPNGRYDEAIARGREWIEGMQSRDGGFAAFDADNLEYYLNNIPFSDHAALLDPPTEDVTARCVSMLAQLGETVDSSSSMAAGVEYLRRTQLAEGSWYGRWGLNYIYGTWSVLCALNVAGVDHQDPVIRRAVNWLVSIQNADGGWGEDAVSYRLDYKGFEGAPTTASQTAWALLALMAAGEVENPAVARGIKYLIDTQTKKGLWDEQRYTATGFPRVFYLRYHGYSKFFPLWALARYRNLRSTNSKAVGVGM

SEQ ID NO: 179 - protein, 652 aa, Nitrococcus mobilis
MEQQPELISGGVGGVAYPWDLGSQAIEEAILAARAALLAHLHPDGYWCFELEADCTIPAEYIMMMHYTGELEAALELKLARYIRECQLQEGGWPLYYGGAMDISCSVKAYFALKLAGDDPEAAHMRRARKAVLERGGAVNANVFTHIALALFGEIPWRGVPFMPPEILLLPRWFPFHLSKVSYWSRTVMVPLFILAAHKPRARNPRAIHISELFVTDPQLETGYFKARSRLNRLFITLDALGRRIEPFIPRAVRAKALRRAAEWFITRLNGEHGLGAIFPAMVNSYEALELLGYAADHPLRQQVRKGLRDLVVEQADRAYCQPCLSPIWDTALACLALQEADRGSSSAQVRHALDWLQARQLLDTPGDWSEQHPSLPGGGWPFQFRNDHYPDLDDTAIVAWAMQRASDPERYGAAIRRATVWLLGMQSANGGFAAFDSDNTRYYLNEIPFADHGALLDPPTSDVTARVVALLGSLDGEVHDRSALNRAVAFLHREQEAEGCWYGRWGTNYIYGTWSVLTALEQLGYDFNAPWVRKAVIWLKSVQRDDGGWGESNDTYLDHRPQDRQADESTPFQTAWAVLALIAAGECRSPEVWRGVEYLLRHQRPDGLWYCPWFTAPGFPRVFYLKYHGYDAYFPLMALARYRNCVLDNDA

SEQ ID NO: 180 - protein, 659 aa, Nitrosococcus oceani
MTRALRQAPESAGAIGIAAASPATETSGQDTHPREISGAITAARDALLKLQQADGHWCFMLEADCTIPAEYILWTHFTGELEPEIERKLAARLRAKQASHGGWPLYEGGDLDISCSVKVYYALKLVGDDPNAPHMRRAREAILAQGGGARANVFTRLALAMFSQIPWRGVPFIPVEIMLLPRWFPFHLSKVSYWSRTVMVPLAILYSLKAQAQNPRNVHIQELFTVPPEQERHYFPVRSRLNKILLSVERTARLLEPLIPSMLRRRALKKAETWFTERLNGEDGLGGIFPAMVNAHESLILLGYSPDHPWRVQAKKALQNLVIEEKNSASCQPCLSPIWDTGLAALALQETEGGHTTAPVIRALDWLKERQILEQSGDWQVQHPNLKGGGWAFQYNNSYYPDLDDTALVAWSMDQAATPERYGEAIGRACDWLCGMQSRNGGFAAFESDNTHYYLNEIPFADHGALLDPPTADVTARCIVLLGRLNKPQYAETLQRALDYLRREQEPNGSWFGRWGTNYIYGTWSALTALEQANIDPQEGFIRKAVEWLKQVQRLDGGWGEDNYSYFDSSLAGRYQESTPVHTAWALLALMAVGEANSEAVKKGIAYLLQIQQEDGLWDHPAFNAPGFPRVFYLKYHGYDKFFPLWALARYRNHLNRQC

SEQ ID NO: 181 - protein, 666 aa, Nitrosomonas europaea
MSISPTFSGSSLQKSSLSDHSTISEPFTVVDRVNGISAVALDDAITRARSALLAQQREDGHWCFSLEADCTIPAEYILMMHFMDEIDTALERRIANFLRNRQVTDGHGGWPLYYGGDFDMSCSVKVYYALKLAGDSPEAAHMVRARNAILERGGAARSNVFTRLLLAMYRQIPWRGVPFVPAEIMLLPRWFPFHLSKVAYWSRTVMVPLSILCTLKAKAANPRNIHVRELFTVDPEMEKNYFPVRTPLNHLLLYLERLGSKLEPLIPSFIRRRALKKAEQWTIERLNGRDGLGAIFPAMVNAYEALTLLGYDHDHPLLQQCRLALRELLVNEGEDITWCQPCVSPVWDTVLASLALQEDERADNGPVRHALDWLVPLQALDQPGDWRNSRPDLPGGGWAFQYANPHYPDLDDTAAAAWALCQADTEDYRTSITRAADWLAGMQSSNGGFAAFDIDNVHYYLNEIPFADHGALLDPPSSDVTARCIGLLALNGEARHQETVKRGLTFLFNEQEPSGAWFGRWGTNYVYGTWSVLEALKLARVDHDHQAVKRAVQWLKSVQRADGGWGETNDSYLDSELAGQLETSTSFQTAWAVLGLMAAGEVGSTAVRNGIDYLIRTQSAAGLWEEPWFTAPGFPKVFYLKYHGYSKYFPLWALNRYRAMNSRSVV

SEQ ID NO: 182 - protein, 670 aa, Nitrosomonas eutropha
MSISQAFFRTLIQKSSLSDSSLVSENFPADDVAGNEANEISAVTLDEAITRAYTALLAQQREDGHWCFPLEADCTIPAEYILMMHFMDEVDTVLERKIANFLRTRQVTDGHGGWPLYYGGDFDMSCSVKTYYALKLAGDSPEAAHMVHARNAILERGGAARSNVFTRLLLAMYRQIPWRGVPFVPAEIMLLPRWFPFHLSKVAYWSRTVMVPLSILCTLKAKAINPRNVHVQELFVVDPVKEKNYFPVRTSLNRLLLYVERLASKLEPFIPSFIRRRAVKKAEQWVIERLNGNDGLGAIFPAMVNAYEALTLLGHDRDHPLLQQCRQSLRELLVDEGEEITWCQPCVSPVWDTVLATLALQEDKQADSEPIRRALDWIVPLQILDEPGDWRDSRPNLLGGGWAFQYANPHYPDLDDTAAVAWALIQTGAEDYRVSITRAADWLAGMQSSNGGFAAFDIDNAYYYLNEIPFADHGALLDPPTSDVSARCVGLLALNGEVRHQEAVKRGLDFLFNEQESSGAWFGRWGSNYIYGTWSVLEAFRLARVDKGHQAVQRAIQWLESVQRADGGWGETNDSYLDPQLAGQLEASTSFQTAWAVLGLMAAGEVENTAVRKGIDYLLRTQIATGLWEEPWFTAPGFPRVFYLKYHGYSKYFPLWALNRYRTLSSKSAV

SEQ ID NO: 183 - protein, 665 aa, Nitrosomonas sp. AL212
MDGSQRISDMSQQPEGIAVSDEISSAYSVSSLNQDEINVDELENKLTQARSAMLSLQKPDGHWCFPLEADCTIPAEYILMMHFMDEIDVILENKIARFIREKQDLTHGGWPLYYGGAFDISCTIKSYYALKLVGDSPDAAHMVRAREAILERGGAAKANVFTRLLLAMYEQIPWSGVPVVPTELMLLPSWFPFHISKVSYWSRTVMIPLSILCTIKARAINPRNVDIRELFIVPPEQEKNYFPQADTWLKRAFMLVERVLSRVEPKLPQAIRQYSIRKAENWTLERLNGECGIGAIFPAMVNAHESLALLGYAYDHPSRVQCRNALRGLLVDEGERAWCQPCTSPVWDTVLTCLALQEDPAADQGPVLKALDWLVDQQVLDEPGDWRDKRPDLLGGGWAFQYANPHYPDLDDTAAVAWALDQSDAQRYQKPLDRAANWLAGMQSRNGGFAAFDIDNTYHYLNEIPFADHGALIDPPTSDVTARCVGLLGKYGKHQREVWRGISFLLREQEKNGSWFGRWGTNYIYGTWSVLEAFQLANFDMQHTSVRRAVKWLESVQRVDGGWGETNDSYLDIQLAGQFPQTSTTFQTAWAVLGLMAAGEVNSKSVRRGINYLLHNQADDHLWEDPWFTAPGFPRVFYLRYHGYSKFFPIWALVRYRALTKERVS

SEQ ID NO: 184 - protein, 653 aa, Nitrosospira multiformis
MKKFGGMARTSLQAQSPGSNNTPSMDEKMLKAGLEAARGALLAQQREDGHWCFPLEADCTIPAEYILMMHFMDEVDLDLEVRIARFIREKQDVAHGGWPLYYGGEFDLSCSVKAYYALKIVGDSPDAPHMVRARAAILKHGGAARANVFTRLLLAMYDQLPWRGVPFVPVEIILFPKWFPFHTSKVAYWSRTVMVPLSILCSLKARAANPRKVAIRELFTVPPGEERNYFPVRTALNRVFLLIERTLSLLEPFIPQGVRRLALRRAESWIVERLNGDSGLGAIFPAMVNAGEALALLGYPYDHPAREQCRKALRLLLVEEGERTWCQPCVSPVWDTVLTCLAFQEDTEVDQKPIRKALDWLVPCQVLDAPADWQEDHPGLPGGGWAFQYANPHYPDLDDTAAVAWALYQADPKAYQESISRAADWLAGMQSSNGGFAAFDSDNTYYYLNEIPFADHGALLDPPTSDVSARCAGFLALYGQSRHKQALERSLAYLFNEQEASGAWFGRWGSNYIYGTWSVLEAFRLAGIDAGHPAIRRAVHWLKSVQREDGGWGESNDSYLSPQQAGQFHTSTSFHTAWALLALMGAGEWRSHEVHRGIAYLLREQDSDGLWHEPWFTAPGFPRVFYLKYYGYTKYFPVWALTRFHALNRKFPG

SEQ ID NO: 185 - protein, 638 aa, Nostoc punctiforme
MQTQDRVKVNQVAEAIAASQQYLLSIQNPAGYWWAELESNVTITAETVLLHKIWGTDQTRPLHKVEAYLRQEQRQHGGWELFYGDGGELSTSVEAYMALRLLGVPATDPAMIRAQAFILQRGGISKTRIFTKLHLALIGCYNWRGIPSLPPWIMLLPKAFPVNIYEMSSWARSSTVPLLVVCDRKPVFITDPTINLDELYAEGIDRVRWELPQSGDWTDLFLTLDQGFKWAESLNLVPFREEGIKAAEKWILERQEATGDWGGIIPAMLNSMLALRCLDYDRSDPIVERGLQAIDNFAIETDNSYRVQPCVSPVWDTAWVMRALVESGFVPDHPAVVKAGEWLLQKQILDYGDWAVKNRQGKPGAWAFEFENRFYPDVDDSAVVVMALHLAKLPNEKIKQAAIARAVNWIASMQCKPGGWAAFDLDNDQDWLNSIPYGDLKAMIDPNTADVTARVVEMLGACDLSIDSDNLERSLTYLLREQETEGCWFGRWGVNYIYGTSGVLSALALIDPQRHKLSIERGAAWLLGCQNLDGGWGETCRSYDDPSLKGKGDSTASQTAWALIGLLAAGEATGKLAVKAIEQGIGYLMATQQPDGTWFEANFTGTGFPCYFYLKYHLYQQYFPLIALGRYQAAIKES

SEQ ID NO: 186 - protein, 637 aa, Nostoc sp.
MRTQDRVQVNSIAEAIAASQKYLLSLQNPAGYWWAELESNVTITAEVVLLHKIWGTDKTRPLHKVEAYLRSQQKQHGGWELFYGDGGELSTSVEAYMALKLLGVPATDPAMIQARDFILQRGGISKTRIFTKFHLALIGCYNWRGLPSLPAWVMLLPNQFPVNIYEMSSWARSSTVPLLIVFDQKPVYQVNPTITLDELYAEGVENVRYELPRSGDWTDLFLTLDEGFKLAESFNFIPFREEGIKAAEKWIIERQEATGDWGGIIPAMLNSMLALRSLGYDTNDPIVERGLQALDNFAIETVDCYRVQPCVSPVWDTAWVIRALIDSGIAPDHPAIVKAGEWLLQKQILDYGDWNVKNRQGKPGAWAFEFENRFYPDVDDTAVVVMALHAAKLPNEQLKQKACDRALQWVASMQCKPGGWAAFDLDNDQDWLNSVPYGDLKAMIDPNTADVTARVIEMLGACNLSIDSHNLERALTYLLNEQEAEGCWFGRWGVNYIYGTSGVLSALALINPQKYQRHIQQGATWLVGCQNPDGGWGETCFSYNDPSLKGQGDSTPSQTAWALIGLIAAGEATGNFAHDAIERGINHLVSTQQPDGSWFEAYFTGTGFPCHFYLKYHYYQQYFPLIALGRYQAIKSL

SEQ ID NO: 187 - protein, 654 aa, Oligotropha carboxidovorans
MTSDTASAAALDPRRLATSITRASRALHDVQQPDSHWVFELEADVTIPAEYVMMRHYFAEPVDAEIEAKIAKYLRRMQNDNGGWSLFYGHEFDMSASVKAYYALKMIGDSPDAPHMKKAREAMLARGGASRANVFTRIMLALFGQVSWKAVPMMPVEIMLLPRWFPFHLTKVSYWARTVIVPLLVLMTLKPRAKNPRGIGVRELFLEDPQTVGPTPKAAHQSQLWFTSFDIIDRVLRITDPFFPKGMRKRAIAKAEAFVTERLNGVDGLGAIFPAMVNSIMMYDVLGYPPNDPNRALARESVERLLVIKDDEAYCQPCVSPVWDTALAAHSMLESGEAADIEAAKAGLDWLLPRQVLDLKGDWADKRPDVRPGGWAFQYNNAHYPDLDDTAVVVMAMDRVRRLDGTTKYDEAIARATEWILGLQSENGGWAAFDADNLEYYLNNIPFADHGALLDPPTEDVTARCLSMLAQLGDTLETSEPMRRGVEYLRKTQLPDGSWFGRWGINYVYGTWSVLCALNAVGVPHDDPMIAKAADWLESIQNEDGGWGEDGNSYKLNYKGYERAATTASQTAWATLALMAAGRVDRDATQRGIDNLVQSQEADGFWGEPYYTGGGFPRVFYLRYHGYSKFFPLWAMARYRNLRSSNSRFVGAGM

SEQ ID NO: 188 - protein, 609 aa, Paenibacillus sp.
MRSELLQLQSADGSWRLCFDSGTMPDSYFIIILRMLGYSQDEALIRQIASRILSRQLPNGTWKIYPDEEDGNLDATAEAYFALLYSGFLTKLDPRMQLAKQFILSKGGLSKIRSLLTQAIFAAAGQASWPKSMRIPLEVFFSDNGIGIDLFSLSGHARVHIVPIIMLANAQFVQHSASMPDLSDLFAGSSKRFENDSPWIAALATLIGSLSLSELLPFESPTPQEKAVQFLFDRLEPDGTLLTYTTATMFMILVLLMLGYSSSSPLIHRMVSGIHSVICANSHVQIASSEVWDTAMLVHALRKAGVNPTSTALENAGAYLRQRQQTQLGDWAIRNPGTPAGGWGFSNVNTLYPDVDDTTAALRAIQPYSSRTPELQADWQRGLNWVLTMRNDNGGWPAFERQGSRLPITFFNFEGAKDIAVDPSTVDLTSRTLQFLGQELGMNAGNSWIESTLRWVLSQQESNGSWYGRWGITYVHGTSAALQGLTAVGIAEDHPAVKKGVDWLLQVQNEDGGWGESCISDKVRRYVPLNFSTPSQTAWALDGLTAALPKPTPALERGVDALLQSLDRHDWTYTYPTGGALPGSVYAHYASNNYIWPLLALSNIWQKYS

SEQ ID NO: 189 - protein, 609 aa, Paenibacillus sp. JDR-2; identical to SEQ ID NO: 188

SEQ ID NO: 190 - protein, 642 aa, Paenibacillus sp. oral taxon 786
MALSNGEIREEIQRLSEELIQRQEPDGSWRFCFENGITIDACTIILLRTLNVDKEELIRQLHDRIVAAQQPEGCWRWYHDDKEGHLSATVEAYYALLCSGYSRPEDEPIQRAKRYILDRGGIGQARSLFTKAILAATGQRKWPASLSLIPIEILLLPESLPLNFYDFSGYSRVHLVPLLIMAERNFRTRSVRTPDLSELFLDARNGEEDPLTLTPESREPLKLIQSGLAHLVGTPRRIRQAAVNRAEQYMLDRIEGDGTLYTYASCTVLMVFALLALGYEPQHPVIQRAVEGLSQMKFTVDSTGQGGTRYVTIQNSPSTVWDTALISYALQEAGVSSSHPAIQRAADYLRNRQHRRPGDWQIHNPGIVPGGWGFSETNTFVPDVDDTTAALRALSALHGSEPAVLGAWNRGLNWVWSMQNNDGGWPAFEKNTNKEMLTWLAIEGAKSAATDPSEADLTGRTLEYLGNFAKLSVRQDWVARGADWLLSHQEADGSWYGRWGICYIYGTWAALTGLMAVGMPADHPGIAKAANWLIRIQNADGGWGESCRSDQVRRYVPLHASTPSQTAWALDALIAVHDRRAPEIERGVARLIALLHEDDWPSTYPTGAGLPGYFYVHYHSYRYIWPLLALSHYVNKYGDSSP

SEQ ID NO: 191 - protein, 603 aa, Paramecium tetraurelia
MIKKILVLILLMVVVTSKVDIERVQTVIRDAREICWNELTDNEWVYPTYLGTLFLSEYYFELKALGIQNSQFEESKFTQILLGSQLPDGSWVQVEDAYIQTGQLDATIFNYWYLKAVGIDIHTDTMKKAQEWIKANGGIEKAQTMTKFKLAMFGQYPWKKLFKIPLILFYKKFNPLYIKDITAQWVYPHMTALAYLQNQRIIFNVAVSISELYKNKAPKIKNHQKKGRPSFFINNLVQEMLKLRQPMGSFGGYTVSTLLSMLALNDYTGRTNKHKSEISDALKKGLDFVEFNYFNFRQAYHGSLDDGRWWDTILISWAMLESGEDKEKVRPIVENMLQKGVQPNGGIEYGYDFGYAPDADDTGLLLQVLSYYGTDYADAMDKGAEFVYSVQNTDGGFPAFDKGKMGKNPLYKYAFKIAGIADSAEIFDPSSPDVTAHILEGLISSDRSNYDVVVKSLKYFMDTQENFGSWEGRWGINYIYAAGAVLPALKKMNNGWAKAVNWLVSKQNADGGFGETTLSYRDPKKYNGIGVSTVTQTSWGLLGLLAVEDHYDVKEAIEKARDGEFKDISVVGTGHRGLLYLQYPSYARSFPVISLGRFLDQQR

SEQ ID NO: 192 - protein, 737 aa, Pelobacter carbinolicus
MDKIKMKNINQPKFRVFRGGQKAATPCPGTTNERRGALDRGRLSASLKHSREWLLSLQADAGNWVFALEADTTIASEYVMLQRFLGRPLAPELQQRLANYLLSRQLPDGGWPLYAEDGFANISTTVKAYLALKLLGYPTHCDPLVRARQIVLALGGAEKCNVFTRIALALFGQIPWRTTPAMPVEIMLLPRWFYFHLSKISYWARTVVVPLLILYAKRPVCRLEPWEGIPELFVTPPDKLGYLDVCKPGQWRKNVFIWVDRLTRKMVRCVPRRLHNLALRAAETWTREHMQGAGGIGAIFPAMANAVMALRTLGCSPDDADYQRGLKALDDLLIDRCDVPPREDTPVSPCWCTGTSAAPMLDPSPAGSHAQGGDQGICQPCASPIWDTGLALTALLEGGLDARHPAVDRAVRWLLDQQVDVKGDWAQRVPNLEAGGWAFQFENALYPDLDDTSKVLMSLIRAGAMDNPGYRQELSRAINWVIGMQNSDGGWGAFDVDNNYLYLNDIPFADHGALLDPSTADVTGRCIEMLAMAGFGRDFLPIARGVDFLRREQEDFGGWYGRWGVNYIYGTWSALSGLIHAGEDLQAPYIRQAVGWLESVQNPDGGWGETCYSYDDPALAGRGVSTASQTAWALLGLMAAGEVDNLAVRRGIQYLVEEQNRAGGWDERHFTGTGFPRVFYLRYHGYSQYFPLWALGLYERLSSGNPSRQQMVRRAGPAGLHLPVLDRRKKLRRKRKA

SEQ ID NO: 193 - protein, 695 aa, Pelobacter carbinolicus
MNVIRQLNSGVNAAKSLDDGIESAIEWLAENQDKEGFWVGMLESNSCIEAEWILAMHLLGVKDDPKYDKVVQAILNEQREDGSWAVYYDAPAGDINATVEAYAALRTAGFGAGDERLIKARNWIFSHGGLKNVRVFTRYWLALIGEWPWDETPALAPEIIYLPAWCPLNIYDFACWARATLVPLSVLSVRRPVKPLPAESRLDELFPEGRENADYSLPESEKGLAERFFLVVDWFLKKYNRLPMQFGREKAIRLCLEWIVRHQDYDGGWGGIQPPLIYSLIALNTEGYGINHPVISKGLDAFNPPWAYEKNGGVYLQCSESPVWDTLFTMLALFESGCSFDDTPMMRPALDWILSKQITSWGDWQVKVRGVRPGGWAFERANTAYPDVDDTALALVVLAEARRHVKDSAAVDAALERAEEWILGLQCRNGGWAAFDRDNNSAIVTKIPFCDFGEVLDPPSVDVTAHVVEALAALGRDRHDPVVARALKYIRSEQEPGGSWFGRWGVNHIYGTCAVLPALAAIGEDMRAPYVLRAADWLVRHQNDDGGWGESCASYMDDSQCGQGSSTASQTGWALMALVAMSSHDYDEAIRRGLDYLLSHQKSGTWDEPQYTGTGFPGYGVGERTNLKEAGATLDQGCELARGFMINYNMYRHYFPLIAMARARRHLGLAANPRHQDSRSSVEVAPEALRGRACG

SEQ ID NO: 194 - protein, 719 aa, Pelobacter propionicus
MKKATRSVFSLLDGGKISDSGSRGDSRHAGSRLDSVTKSAAALLASRQNPDGHWVFDLEADVTIPAEYVMMRCFIGEPLDSDMASRLSAYLLERQLPDGGWPLYAVDGNANISATVKAYFALKLLGHDKYAPHMVSARRMILAQGGAERSNVFTRITLALFGQVPWHTTPAMPIEIMLLPKWFFFHLSKVAYWSRTVIVPLLILYNKQPVCRLGYSEGIAELFSTSPDMLVHLDHFRYRAWRKNAFIVLDRLLKRTMHLVPGRIKRRALEEAERWTRERMKGDGSIGAIYPAMANAVMALKTLGCGDSDPDYLRGLRAIDRLLIHGKPEAGALPADGAGTLFPVLDGASSAAVDLYPASLSDTAKSHAFSFCQPCNSPVWDTALSLTALSEAGGGGYSPERAMEWLFNRQIATQGDWTERCPGLECGGWAFQYENALYPDVDDTAKVLMSLFRAGALERGEYPEKIAKAVRWVLGMQGADGGWGAFDVDNNHFYLNDIPFADHGALLDPSTADLTGRCIEMLGMLGHGPDYPPITRGIEFLREEQEPFGGWFGRWGVNYIYGTWSVLSGLSQAGEDMGRPYVRKAVEWLVSCQNDDGGWGETCASYDDPSLAGSGASTASQTAWALLGLMAAGEADHAAVRAGIAYLADSFADGWDERHFTGTGFPRVFYLRYHGYSLFFPVWALGVYARHREGGKTVQEQVRERGVNGVFDFVMGGSA

SEQ ID NO: 195 - protein, 679 aa, Pelobacter propionicus
MNPAKYKISSSLTSLNAEPVEQAPLPAKRTGSKVHRLPPSIWKKMVAEAKSPLDKGIERTRDFFLREQLPDGYWWAELESNVTISAEYVMLFHFLGMVDRERERKLANYILAKQTSEGFWSLWHNGPGDLSTTIEAYFALKLAGYSADHPAMAKARAFVLANGGIIKARVFTKIFLALFGEFAWFGVPSMPIELMLLPDWAYFNMYEFSSWSRATIIPLSVVMSERPVRKLPPRAQVQELFVRPPRPTDYTITREDGLFTWKNFFIGADHLIKVYESSPIRPFKKRAVALAENWILEHQEQSGDWGGIQPAMLNSILALHCLGYANDHPAVAKGLDALANFCIEDDDCIVLQSCVSPVWDTALALVALQEADVPADHPALVKAAQWLLNLEVRRKGDWQVKCPELEPGGWAFEFLNDWYPDVDDSGFVMLSIKNIKVRDRKHREEAIKRGIAWCLGMQSENGGWGAFDRNNTKYLLNKIPFADLEALIDPPTADLTGRMLELMGNFDYPKSHPAAERALAFLKKEQESEGPWWGRWGVNYLYGTWSVLCGLEAIGEDMNQPYIRKAVNWIKSRQNNDGGWGEVCESYFDRSLMGSGPSTASQTGWALLALMAAGEANSRAAAQGVKYLLETQNEDGTWDEDAFTGTGFPKFFMIKYHIYRNCFPLTALGRYRRLTAAKG

SEQ ID NO: 196 - protein, 669 aa, Penicillium chrysogenum
MSMTSREDHDASSLISQVEHALKLSNDYALGLVHPDGHWYGEMNTNVTVTAEYVFLRQALRLDLKTDIAAYCHYLLSQQNSDGSWGLAPEYPGDVSTSTEAYLALKILGTSPHTPAMRNARAFVLKAGGIARVRIFTRIFLATFGLFPWSAVPELPVELMLLPSICPINIYKFASWARGTIAPLLIICHHQPVYSLPNGKSTDNDYLDELWVDCTNKSVPYGLPLWDLMSQGEFAGLAFGVLDKVLYQLNGLRSIPLIRAYARKQCIQWILERQEKTGDWAGIFPPMHANMYAFTLEGYKLDDDPVRLGFQALERFAWEDEKGKRIQACVSPVWDTALMTIGLCDAMSPNKQTIDHALAWIRARQLLEPRGDWRVYRPQLAPGGFSFEYENSWYPDVDDTAAIILAQVKHDNGSIGSNSVIAAATWILGMQNPDGGWAAFDVENDKLFLNKIPFSDMDSLCDTSCADITGRILEAYGLMMMKYFSAKSDADPLLHTLRAACMRGMHYLASTQEPNGSWYGRWGCNYIYGTSHVLCGLAYFVEKRLVCVMVKSALQWLKSRQNDDGGWGESLLSYQSPDREQQASTPSQTAWALMGLLSHLPVTDDAIERGIRYLVSSQRPEKGIGSSWPQAEYTGTGFPNHFYLGYDYYRHYFPMMALGRYLQGSRGLN

SEQ ID NO: 197 - protein, 705 aa, Planctomyces limnophilus
MTSGTFGAKRVDLLAAFEHSAPAEKTRETCVGLQTAIARTRQYLLDQQHSEGFFVAELEGDTILESEYILLLAFLNEGQSPDAQAAARYLLTKQNTDGSWSNFPGGPIDVSCAVKAYLALRITGHAADEPALIRAREAILQAGGVERVNSFTRFYLAMLGLIPYSLCPAVPPEVVLLPDWFPINLSQMSAWSRTIVVPLSLLWAFQPAVELNDADGHQITIEELYASPEKQLPRFIRGVNHESNSNGWMNWSRFFFRVDQCLKSIESYGIKPLRSRAVRKCVQWILDRQEMSDGLGAIFPPIVWTLIGLKCAGFDDQHPMVQKQRDELNRLMLREQDALRLQPCLSPVWDTAISIIALRESGVEPDHPALSKARNWLLSKEVRHAGDWSKAHPETPVSGWYFEFNNEFYPDVDDTAMVLIALASTLPEEATPLAISHGVLPVQTGWSAESTSRVQALKQLENHRPVLEAMGRGVQWLKALQSKDGGWGAFDSDINKELLTKVPFADHNAMLDETNADISARVLEAYAAVGISFNDPSVQRALEFIWNDQEDDHAWYGRWGVNYIYGTWQVLVGLTAIGISAHDPRLVRAAGWLKSKQQACGGWGETPATYDNPTLRGQGTPTASQTAWAVLGLIAAGEQNSIECQRGVEFLLKTQKHNGTWDEEEFTGTGFPRVFYLRYHYYPLYFPLMALGRFARAGGRVNFAG

SEQ ID NO: 198 - protein, 697 aa, Planctomyces limnophilus
MEDLTQKLQQALQLASRALLNERVRPGLAHWEGELSTSALSTATAVMALFQYAKCQQASGRLQKVFDGKSEGDWRLIEQGLAWLLQHQLADGGWGDTDKSISNISTTMLAHATLVACREAVRQKSLVLNASDIDAAIERSGRLIEELGGIQAIRDRYGKDHTFSVPILTHAALAGLVSWNEIPALPYELALLPHRFFEVIQLPVVSYALPALIAIGQTLHLRQRTWNPWWWVRRAAIPGTLQKLQSIQPESGGFLEATPLTSFVTMCLASVGRVDHPVTQAGLKFIRDSVRPDGSWPIDTNLATWVTTLSINHLGAEAFSSDEREALMRWLLQQQYRTMHPYTNAAPGGWAWTNLSGGVPDADDTPGAMLALMELDRVSVSSQESLSIEQALYQAALWLIKLQNRDGGWPTFCRGWGALPFDRSSNDITAHCLRALIQYERRLNDVTVDATGDTTSRPLAVEVPSPKLREQMQRSIQQGFEYLEKTQREDGSWLPLWFGNQHSPDDENPLYGTARVLLAYADAGLEGSSAALRGCDWLVRHQHADGAWGPGTSIETADTSDAESDVEGEPASIEETALALMALCRFDATHNVLHRGASWLITKVENETWREPTPIGFYFAKLWYYEKLYPQVFTVGALKALALRLGSALTTVSENEPAPSSAEPPIPPIATDRVADSMHLQRTSPSINLANGGITLA

SEQ ID NO: 199 - protein, 620 aa, Planctomyces maris
MSETISCQRIQAAYQRSRAELLSLRNSTGHWTGELSTSALSTATAIMALEMIRRKRLPADLSLNTYIDNGIRWLAEHQNSDGGWGDTVKSFSNISTTMLCHAVFHATKSTEQYVSHVVNARQYIDRVGGVEAVVARYGKDKTFSVPILTHCALAGLVKWKTIPALPFELACLPARFYKTVRLPVVSYALPALIAIGQVRHHFCKPRNPITRLIRKLAVKRSLKKLISIQPSNGGFLEAAPLTSFVTMSLAGMGLTDHPVVQKGLQFLLDSVRPDGSWPIDTNLATWTTTLSVNALEGTLAEFEKTPIREWLLQQQYKELHPYTSAEPGGWAWTDLPGGVPDADDTPGAILALLNLQPDEPDTQQPADLQVALRNGVKWLLDLQNSNGGWPTFCRGWGALPFDQSAADISAHVIRALQAWLQTEPESAEAELRLRAERAVRKCFKYLATVQRPDGSWLPLWFGNQHVENDENPVYGTARVLAAYAQGEQCGSIQAEQGILFLKSVQNLDGGWGGATSAPSSVEETALAVDTLLALGLEPADPVVAQGLNWLSGRVENGTYTETTPIGFYFAKLWYFEQLYPIIFTVSALHRAETVLKKSADDNLRLSLEEEDYPIMSVKEK

SEQ ID NO: 200 - protein, 770 aa, Polypodiodes niponica
MALPFNQDSYKGDDEADVSKGAAKSPPSLEEAIQRSQEFLLAQQFPEGFWFGELEANVTIISHTVILYKLLGIEENFPMYKFERYLRRMQCSHGGWEIAYGIGSYLSATIEAYIALRLLNVPQSDPALQKALRVILDSGGVTKARIFTKICLALLGSFDWRGIPSLPPWLILCPTWFPLSIYEVSSWARGCIVPLLVILDKKPVFKVSPEVSFDELYAEGREHACKIIPISGDWTSKFFITVDRVFKMMERLRVVPFRQWGIREAEKWILERQEESGDYVNIFPAMFYSVMCMKVLGYETTDPVVQRALLGFKGFTIETADECKVQSTVSPIWDTAFIVRALVDSGIPPDHPALQKAGQWLLQKQILKHGDWAFKDRQNPVNQRGFACLQRDSQIETADECRVQSTLSPVWDTAFVVKALVDSGIPPNHPALQKAGQWLLQNQTLTHGDWAFKTQSGHLAAGGWAFQSHNRWYPDADDSAAVMMALDCIELPDEDVKNGAIARGLKWISALQSRNGGWAGYDKNCDQQWINKVPFNDLNGILDVPTADVTARVLEMVGRLSRLGAVGTPYSPRHCTLVESIPHLLLPETIARGLAYLRREQEGEGCWWGKWGVNYIYGTCGALLALSQVAPTTHQEEIARGAKWLAQVQNRCDKQKAAQGPRDGGWGESCFSYDDPALKGQNDASTASQTAWAVQGLLAAGDALGKYEVEAIEQGVQYLLATQRKDGTWHEAHFTGSCFAQHFYVRYHYYAQHFPLSALGLYRTRILQHQ

SEQ ID NO: 201 - protein, 692 aa, Polypodiodes niponica
MLPYNQNSYKEALHGGHAAHNPPTLEEAIKRSQEFLLAHQHPEGFWWGDLECNVTSASHTLILYKILGIADRYPLHKFEKYLRRMQCSHGGWEMSFGDGGYLSATIEAYICLRLLNVPQSDPALQRALKNILARGGVTKARVFTKVCLALLGGFDWAALPSLPPWLMLFPAWFPWNIYEAASWARGCVVPLIVLLEKKPVFQVKPEVSFDELYVEGRAHACKALPFSAHDWVSNIFVAADRAFKLMERFGAVPFRQWSIKEAKKWVLDRQEEMGDFIGYNPPMLYFAVCLKLWGYEVTDPLLQRALLAHKKLTVETEDECWLQSSQSPVWDTALVIPALVESGLPPDHPALQKAGQWLLEKQILKHGDWALKTGGGRMQDDIGGGWAFQFVNSWYPDVDDSAAVVIALNCIKMPDEDVKNGAIARCLKWIAFMQGRNGGWAAFDRDSNQRWMDATPFSDIEAMLDVSTADVTARVLEMVGLMRLKHAAQPANNSLGKAHRHISTESIARGVDYLTKEQEKEGCWWGRWGVNYIYGTRGALMGLSQVAAKTHKKEIARGAAWLVKVQNKKNEKKQGAQDGGWGEACFSYDDPATKGQNSRSTASQTGWAMQGLLAAGEVLGRKYEMEAVEEGVQFLLDTQRKDGSWSEAEFTGGGFPKHYYLKYHYFAQHFPLSALARYRARLLQLSRPKNQA

SEQ ID NO: 202 - protein, 355 aa, Populus trichocarpa
MVYSYEMMVLLDYPEDHPLRVECKAALKKLVVHRDDGSSYCQPCLSPVWDTAWSVMALEQAPSDARTETAIARAYDWLTDRQVLDLRGDWENNAAPSTPPGGWAFQYENPYYPDIDDSAVVLAMLHARGKRTGQPGRYEMPVARCLDWIIGLQSRNGGFGAFDANCDRDFLNAIPFADHGALLDPPTEDVSGRVLLALGITERPQDATARERCIQYLRDTQQPDGSWWGRWGTNYIYGTWSVLAGLGLAGVDRKLPMVRNGLQWLRGKQNADGGWGETNDSYARPELAGKHEDGSMAEQTAWAMLGQMAVGEGDADSVHRGAAYLLDAQNEDGFWMHPYHNAPGFPRIFHLKYHG

SEQ ID NO: 203 - protein, 673 aa, Ralstonia eutropha
MSMNEAVLAAPRAAVATAAPALQAPIEALSPLDAGIGHAVDALLAQQNADGHWVYELEADATIPAEYVLMVHYLGETPDLSLEARIARYLRRIQNADGGWPLFHEGRSDISASVKAYFALKMAGDDPQAAHMARAREVILAMGGAETSNVFTRTLLALYGVMPWQAVPMMPVEIMLLPQWFPFHLSKVSYWARTVIVPLLVLNSLRPQARNPRKVGIDELFLGSRDAVRLPPRAPHQHKGWHALFHGADVLLRTAEHVMPRGLRRRAIDAAKAFVRERLNGEDGLGAIFPAMANSVMMFDVLGVPPDDPDRAIARRSIDKLLVVHGDEAYCQPCLSPVWDTALAAHALLEASEPRATAAVTRALDWLRPLQVLDVRGDWTVRRPDVRPGGWAFQYANPHYPDVDDTAVVVAAMHRAARTDHSGRADPNAEATARAIEWIVGMQSANGGWGAFEPENTHLYLNNIPFADHGALLDPPTADVSARCLSMLCQTGATPDKSEPAARALQYLLAEQLPDGSWFGRWGTNYIYGTWSALCALNAAGLGPDAPPLRRAAEWLVAIQNPDGGWGEDGDSYKLEYRGYETAPSVASQTAWALLALMAAGQAAHPAVTRGIDYLLRTQQADGLWHEPRFTAVGFPRVFYLRYHGYARYFPLWALARYRNLERSGNRQVAWGL

SEQ ID NO: 204 - protein, 672 aa, Ralstonia eutropha
MSMNETAFATAVPRIAPASAGDSPAPRDAAQALDQGIGRAIDALLHQQRPDGHWVYELEADATIPAEYVLMVHYLGEAPDLELEARLARYLRRIQNPDGGWPLFHEGRSDVSASVKAYFALKMAGDDPQAAHMQRARRAVHALGGAEASNVFTRTLLALYGVMPWLAVPMMPVEIMLLPQWFPFHLSKVSYWARTVIVPLLVLNSLRPQARNPRGVGINELFVGNCHTVGLPPRAAHQHAGWYTVFRGLDALLRVAEPLVPRTLRRRAIAAAQAFVRERLNGEDGLGAIFPAMANSVMMFDVLGVPPDDPARALARQSVERLLVEHGDEAYCQPCLSPVWDTALAAHALLETGEARATAAAGRGLDWLRPLQVLDVRGDWAVRRPLVRPGGWAFQYANAYYPDVDDTAVVAAAMNRYMRAHDVPGRYDEAVARAAEWIVGMQGGDGGWGAFEPENTHLYLNNIPFADHGALLDPPTADVSARCLSMLCQIGATPGKSEPAARALRYLLAEQMPDGSWFGRWGTNYIYGTWSALCALNATGLAPEAPEMRRAVAWLEQIQNADGGWGEDGSSYRLDYRGYEPAPSVASQTAWALLALMAAGAAQHAAVARGIDYLLRTQQSGGLWHEPRFTAVGFPRVFYLRYHGYARYFPLWALARYRNLQRGGAHQVPWGL

SEQ ID NO: 205 - protein, 669 aa, Ralstonia metallidurans
MNQAATITRPQDETLTTSARRPAQPALPDPLDAGIAHVVESLLAQQQSDGHWVYELEADATIPAEYILMVHYLGETPDLVLEGKIANYLRRIQNADGGWPLFHAGASDISASVKGYFALKMAGDNPEAEHMRRARAAIHAMGGAEASNVFTRTLLALYGVMPWQAVPMMPVEIMLLPEWFPFHLSKVSYWARTVIVPLLVLNSLRPQARNPRKIGIDELFVRPCQATRLPRRAPHQSPLWVGVFRTLDAVVRMAEPLFPRGLRQRAIERAREFTVERLNGEDGLGAIFPAMVNSVLMFDVLGVPESDPNRAIARRSIDKLLVIKDDEAYCQPCLSPVWDTSLAAHALLEVGEPRTIAAAARGLDWLLPLQELELRGDWTVRRPNVRPGGWAFQYANPHYPDVDDTAVVAAAMDRVDKGDRSNRYDEAVSRACEWIVGMQSSNGGWGAFEPENTHLYLNNIPFADHGALLDPPTADVSARCLAMLCQLGQMPANSEPAARALRYLLDEQEADGSWFGRWGTNYIYGTWSALCGLNAAGIGTDAPEMKRAAQWLLSIQNEDGGWGESGDSYKLEYRGYEKAPSTASQTAWAMLGLMAAGAGDHPALVRGVEYLLRTQASHGFWDEPYFTAVGFPRVFYLRYHGYSRFFPLWALARFRNLLRDGNRAISWGL

SEQ ID NO: 206 - protein, 661 aa, Ralstonia metallidurans
MTRKTIPASELDAAIVRARDALLDRQHPDGHWCFELECDATITAEYILMMHFVDEIDTALQARMAKYLRAVQRLDGHGAWDLYFGGDLDISCSVKAYFALKAAGDPPDAPHMVRAREAILARGGAAKSNVFTRILLATFGEIPWRGTPFMPVEFVLFPRWAPIHMDKVAYWARTTMVPLLVLCSIRAAAKNPLGVHVQELFVTPPELEREYFPRKRGLQQAFLVADRVVRHLEPLIPRALRRRAIQRAVEWSEARMNGEDGFGGIFPPMVYSYEMMVLLDYPEDHPLRVECKAALKKLVVHRDDGSSYCQPCLSPVWDTAWSVMALEQAPSDARTETAIARAYDWLTDRQVLDLRGDWENNAAPSTPPGGWAFQYENPYYPDIDDSAVVLAMLHARGKRTGQPGRYEMPVARCLDWIIGLQSRNGGFGAFDANCDRDFLNAIPFADHGALLDPPTEDVSGRVLLALGITERPQDATARERCIQYLRDTQQPDGSWWGRWGTNYIYGTWSVLAGLGLAGVDRKLPMVRNGLQWLRGKQNADGGWGETNDSYARPELAGKHEDGSMAEQTAWAMLGQMAVGEGDADSVHRGAAYLLDAQNEDGFWMHPYHNAPGFPRIFHLKYHGYTAYFPLWALGRYRRLAAARASAMQTAKAESAESMTAH

SEQ ID NO: 207 - protein, 647 aa, Rhizobium sp.
MNKHSGNRTAIDPAALEMSIASATEALLAYRHADGHWAFELEADSTIPSEYILLRHYLAEPIDVVLEAKIGNYLRRTQGAHGGWPLVHDGPFDMSASVKSYFALKMIGDSVDAAHMVKAREAIRARGGAANSNVLTRFLLALYGVVSWRAVPVLPIEIVLLPIWSPFHLYKISYWARTTIVPLMVLAVLKPRAKNPKGVGIEELFLQDTKSVGMNPKAPHQSWGWFLLFRGIDGILRVIEPHLPKKLRERAIASALAFTEERLNGEDGMGAIYPSMANIVMMYDALGKDDHFPPRAIARRAIDKLLVIGEEEAYCQPCLSPVWDTALTCHALQEVGGANAVAKAKQGLDWLKPRQVLDVKGDWAVKAPNIRPGGWPFQYNNAHYPDLDDTAVVVMAMDRAQRHAGSKEYATAIARGREWIEGMQSRDGGWAAFDVNNLEYYLNNLPFADHGALLDPPTEDVTARCVSMLAQVGEFTQRSKAVAEGIAYLRRTQHAEGSWYGRWGLNYIYGTWSVLCALNAAGIDHQDPMIRKAVEWLVSIQSWDGGWGEDAISYRLDYSGYEQAPSTSSQTAWALLGLMAAGEVEHPAVARGVNYLKNAQTENGLWDEQRYTATGFPRVFYLRYHGYSKFFPLWALARYRNLRSTNV

SEQ ID NO: 208 - protein, 661 aa, Rhodopirellula baltica
MMAVVENSVSEVLDRRELRGTLDLLRGELLAQRTKDGHWTGELSASALSTATAISAMSAAVRSGKLAGADKAALLEQIQSGRRWLADQQNDDGGFGDTDRSHSNIATSYLVLAAWTLSDQVTGETTDANAISRLRNWIQLAGELDGLRRRYGKDKTFVVPILTNMAIAGLVPWKKVSALPFEAAVVPQSMYRFVGMPVVSYAVPALVAIGQVKFLEGGGCLPPWSLVRRAAIEPSMKVLRSMQPSSGGYLEATPLTAFVVMSLSASGRADHEVTQNGLRFLRDSMLPDGSWPIDTNLANWATSLATTALTMDPDDDRSWSTNELIQWQRGCQYQERHPFTGADPGGWGWTDLTGSVPDADDTPGAIISLRMQATTRPDPLCDDYSRDWPASDSSGSVSANALDTWKACDRGVDWLLGLQNRDGGWPTFCRGWGKLPFDRSSNDLTAHALRAIACLPKRESAKRSRAVQRGLRFLRKNQQADGSWLPLWFGNQDRPEEDNPIYGTSRVLVDVSPALGHDAISRGLYYLINSQNSDGGWGGGESVRETFGLPEGFISSVEETALAVEALVSWWGRIPGNEGGQAAENDIPDGSPWDASMRSALRAAILSGTRWLIDAVQRERHQVAWPIGFYFAKLWYYERLYPLVYTTAALGRVMQRDELLR

SEQ ID NO: 209 - protein, 685 aa, Rhodopseudomonas palustris
MDSILAPRADAPRNIDGALRESVQQAADWLVANQKPDGHWVGRAETNATMEAQWCLALWFLGLEDHPLRVRLGRALLDTQRPDGAWHVFYGAPNGDINATVEAYAALRSLGHRDDEEPLRKARDWILSKGGLANIRVFTRYWLALIGEWPWEKTPNILPEVIWLPTWFPFSIYNFAQWARATLMPIAVLSAHRPSRPLAPQDRLDALFPQGRDSFNYDLPARLGAGVWDVIFRKIDTILHRLQDWGARRGPHGIMRRGAIDHVLQWIIRHQDYDGSWGGIQPPWIYGLMALHTEGYAMTHPVMAKALDALNEPGWRIDIGDATFIQATNSPVWDTMLSLLAFDDAGLGERYPEQVERAVRWVLKRQVLVPGDWSVKLPDVKPGGWAFEYANNFYPDTDDTSVALMALAPFRHDPKWQAEGIEDAIQRGIDWLVAMQCKEGGWGAFDKDNDKKILAKIPFCDFGEALDPPSADVTAHIIEAFAKVGLDRNHPSIVRALDYLKREQEPEGPWFGRWGVNYVYGTGAVLPALAAIGEDMRQPYIARACDWLIARQQANGGWGESCVSYMDAKQAGEGTATASQTAWALMALIAADRPQDRDAIERGCLYLTETQRDGTWQEVHYTGTGFPGYGVGQTIKLNDPLLSKRLMQGPELSRSFMLRYDLYRHYFPMMAIGRVLRQRGDRSGH

SEQ ID NO: 210 - protein, 654 aa, Rhodopseudomonas palustris
MDSGTFNPGGERGNTLDASIDAARAALLGYRRDDGHWVFELEADCTIPAEYVLLRHYLGEPIDAALEAKIAVYLRRTQGAHGGWPLVYDGEFDMSATVKGYFALKMIGDSIDAPHMAKAREAILSRGGAVHANVFTRFLLAMFGILTWRAVPVLPVEIMLLPMWSPFHLNKISYWARTTIVPLMVLAALKPRAVNRLGVGLDELFLQDPKSIGMPARGPHQNRGLFALFGAIDAVLRVIEPLIPKKLRKHAIDRAVAFVEERLNGEDGLGAIYPPMANTVMMYKVLGYPEDHPPRAITRRGIDLLLVIGEEEAYCQPCVSPIWDTSLTCHALLEAGGAEAAQPVREGLDWLLPKQVLDLKGDWAVKAPNVRPGGWAFQYNNAHYPDLDDTAVVVMALDRARRDQPSAAYDNAIARGREWIEGMQSDDGGWAAFDVNNTEYYLNNIPFSDHGAMLDPPTEDVTARCVSMLAQLGETEQTSKAVARGVAYLRKTQLPDGSWYGRWGMNYIYGTWAVLCALNAAGVDHQDPAIRKAVAWLASIQNADGGWGEDGVSYRLDYRGYETAPSTASQTAWALLSIMAAGEVDHPAVARGIEYLKGTQTEKGLWDEQRHTATGFPRVFYLRYHGYSKFFPLWGLARYRNLRATNSKVVGVGM

SEQ ID NO: 211 - protein, 654 aa, Rhodopseudomonas palustris
MTSGTTILGAERGRTLDASIDAARAALLGYRRDDGHWVFELEADCTIPAEYVLLRHYLGEPVDAALEAKIAVYLRRTQGAHGGWPLVHDGEFDVSATVKAYFALKMIGDSIDAPHMAKAREAILARGGAIHVNVFTRFLLSMFGILTWRSVPVLPVEIMLLPMWAPFHLNKISYWARTTIVPLMVLAALKPRAVNKLDIGLDELFLQDPQSIGMPAKAPHQSWGLFTLFGSIDAVLRVIEPLIPKKLRSYAIGRAVAFIEERLNGEDGLGAIYPPMANTVMMYKVLGYGEDHPPRAITRRGIDLLLVVGEEEAYCQPCVSPIWDTSLTCHALLEAGGAEAALPVRKGLDWLIPKQVLDLKGDWAVKAPNVRPGGWAFQYNNAHYPDLDDTAVVVMALDRARRDQPSAAYDNAIARGREWIEGMQSDDGGWAAFDVNNTEYYLNNIPFSDHGALLDPPTEDVTARCVSMLAQLGETAETSSALARGVAYLRKTQLAEGSWYGRWGLNYIYGTWSVLCALNAAGVAHQDPAMRKAVAWLASIQNADGGWGEDAVSYRLDYRGYESAPSTASQTAWALLALMAAGEVDHPAVARGVEYLKGTQTEKGVWDEQRYTATGFPRVFYLRYHGYSKFFPLWALARYRNLRATNSKVVGVGM

SEQ ID NO: 212 - protein, 654 aa, Rhodopseudomonas palustris
MESGNNKQPAAAIGALDASIESATNALLGYRQPDGHWVFELEADCTIPAEYVLLRHYLGEPVDAALEAKIANYLRRVQGAHGGWPLVHDGGFDMSASVKGYFALKMIGDDIDAPHMAKAREAIRSRGGAIHSNVFTRFLLSMFGITTWRSVPVLPVEIMLLPMWSPFHLNKISYWARTTIVPLMVLAALKPRAVNRLDIGLDELFLQDPKSIKMPAKAPHQSWALFKLFAGIDAVLRTIEPLFPKRLRDHAIKLAVDFVEERLNGEDGLGAIYPPMANTVMMYKVLGFPEDHPPRAITRRGIDKLLVIGEDEAYCQPCVSPVWDTALTCHALLEVGGEAAVPPAKRGMDWLLPKQVLDLKGDWAVKRPNLRPGGWAFQYNNAHYPDLDDTAVVVMAMDRSRRATGSREYDEAIARAREWIEGMQSDDGGWAAFDVNNLEYYLNNIPFSDHGAMLDPPTEDVTARCVSMLSQLGETAASSKAVADGVEYLRRTQLPDGSWYGRWGLNYIYGTWSVLCALNAAGVDHQDPVIRKAVTWLASVQNPDGGWGEGAESYRLNYTRYEQAPTTASQTSWALLGLMAAGEVDSPVVARGVEYLKSTQTGKGLWDEQRYTATGFPRVFYLRYHGYAKFFPLWALARYRNLRSTNSKVVGVGM

SEQ ID NO: 213 - protein, 653 aa, Rhodopseudomonas palustris
MDSGSYTTGVERNALEASIDAARSALLNYRRDDGHWVFELEADCTIPAEYVLLRHYLGEPVDAELEAKIAVYLRRIQGAHGGWPLVHDGDFDMSASVKGYFALKMIGDSIDAPHMVRAREAIRSRGGAIHSNVFTRFLLTLYGVTTWRAVPVLPVEIMLLPSWSPFTLTKISYWARTTMVPLLVLCALKPQAKNPKGVGIDELFLQDPKTIGMPVKAPHQNWALFKLFGSIDAVLRVIEPVMPKGIRKRAIDKALAFIEERLNGEDGMGAIFPPMANAVMMYEALGYPEDYPPRASQRRGIDLLLVDRGDEAYCQPCVSPVWDTALASHAVLEADGHEGAKSVRPALDWLLPRQVLDVKGDWAVKAPNVRPGGWAFQYNNAHYPDLDDTAVVVMALDRARKDQPNPAYDAAIARAREWIEGMQSDDGGWGAFDINNTEYYLNNIPFSDHGAMLDPPTEDVTARCVSMLAQLGETMDSSPALARAVGYLRDTQLAEGSWYGRWGMNYIYGTWSVLCALNAAGVPHADPMIRKAVAWLESVQNRDGGWGEDAVSYRLDYRGYESAPSTASQTAWALLALMAAGEVDHPAVARGIEYLKSTQTEKGLWDEQRYTATGFPRVFYLRYHGYSKFFPLWALARYRNLQATNSKVVGVGM

SEQ ID NO: 214 - protein, 656 aa, Rhodospirillum rubrum
MDATAPLRDPGAPSAENCSVDRRELDDVIGESCRWLGERQNQDGHWVFELEADATIPAEYILLNHFLDEIDDAREARIASYLRAIQGKHGGWPLFHDGDFDMSATVKAYYALKLTGDGVDEPHMVRARQAILEHGGAERTNVFTRFTLAMFDQVPWRACPVTPVEALLLPRFAPFHWSKVSYWSRTVMTPLMILYSRRARAVNPRGIGVRELFRRDPEVIRDWLKNPTGHWIGDALIQIDKVLRVIEPAIHWAFRDRAEKWALDFIEERLNGRDGLGGIYPAIANTLMAYHTLGYAKDHPGYRIAREAVDGLCTPHAKGEYVQPCLSPVWDTCLASHAIQEAGQSAGDRAVDQSNAWLRERQVLDVVGDWKSNRGHLRPGGWAFQYNNPHYPDVDDTAVVVMALARSKEDEANREAIARAEEWIIGMQSSNGGWGAFDAENEHDFLNHVPFADHGALLDPPTVDVSARCLGMLAQLGRPKTDPVVARGLDYLWREQEADGSWFGRWGTNYIYGTWSALNAFNAVEWDMTDPRICKAVDWLKSRQRDDGGWGEDCATYWKERRSVSKASTPSQTAWAVLGLMAAGEVDSPEVERGIRYLLEAPRDGGKWEEELYNAVGFPRIFYLRYHGYSAYFPLWALARYRNLTSGNCKRTIHGM

SEQ ID NO: 215 - protein, 554 aa, Rubrobacter xylanophilus
MGRQTRNLTRREPAAEAEERGFRLLDAHRRADSSWVGELSSSALATAMSALALRLLGHPAESGPVAGGLAWLAATRNPDGGWGDAPGEPSNMNATSIAAAALARCAPRRYREEVAGGRRWVEEHGGFAALNDPRTTTLSGPGRTLWALAGLVPPERVRKLPTEMILLPRRIRRTVSTTFPAFLSLSLLHERFRPSPRWRRPLRRRAEREALAWLRRAQGPNGSYEESAFLTSLIAAALTAAGAEGGDIVRRALPFVLRSRRPDGSWPIDRDLENFDTTQAILAHHEAGRPLREAGRVREWLLDNQFRRPFFPTSSPPGGWAWAYPAGWPDTDDTACALRSLRLLGVPAGHPSIRLGLRWLYRMQNRDGSWPTFVRGSRMPFDHGCPYITSQVLSALALMGPEARRGAPLRRALAYLRRAQRPDGSLGSLWFRPHTRGTAAAVEAFSDLGLSGDPLVGRAARWLAEHQNPDGGWGDGHGAPSTAEETAWASAALLRLGGGEAARKGVRWLVEHQDPGGWKPAVIGLYYASLSYSDTFYALSYPLVALARHRRLSR

SEQ ID NO: 216 - protein, 640 aa, Saccharomonospora viridis
MTDVLTRELSPNSTRDRVRSCVSSARQYLLSLQHEEGWWKGELDTNVTMEAEDLLLRQFLGISDEQVTQETARWIRSCQREDGTWATFHGGPPDLSTTVEAYVALRLAGDAMDAAHLRKAREYILDSGGIESTRVFTRIWLALFGEWPWSRLPVLPPEMMLLPDWFPLNIYDWASWARQTVVPLTIVGSLRPTRDLGFSVRELRTGIQRRDLESPLSWAGVFHGLDSVLHRLEKLPLKPLRKVALARAEQWILDRQESDGGWGGIQPPWVYSILALHLRGYPLDHPVLRKALDGLDGFTIRHRTENGWIRKLEACQSPVWDTALAMTALLDSGTPPNDPALVRAADWILRQEIRVSGDWRVRRPALEPSGWAFEFANDHYPDTDDTAEVVLGLQRVRHPEPHRVNAAVERATAWLVGMQSSDGGWGAFDADNTRTLCEKLPFCDFGAVIDPPSADVTAHIVEMLAARGMADSESARRGVRWLLEHQEVDGSWFGRWGANHVYGTGAVVPALVACGISPQHEAVRAAVQWLVAHQNADGGWGEDLRSYVDRTWVGRGTSTPSQTAWALLALLAAGERGEVVRRGVEWLMAAQRPDGGWDEPQYTGTGFPGDFYISYHMYRIVFPLTALGRYLGRGGDVGTG

SEQ ID NO: 217 - protein, 636 aa, Saccharopolyspora erythraea
MTEEVLQRTAAPAEVLAAAREHLLSLQHERGWWKGELETNVTMDVEDLLLRRFLGILTTAETEQAARWIRSRQRADGTWAQFHGGPGDLSTTVEAYVGLKLAGDDVDSEHMAAARAWILERGGIEETRVFTRIWLALFGEWSWDDLPAMPPELVLLPPWVPLNLADWGCWARQTIVPLTVVCTLRPRRDLGVGLAELRSGRRRRKVPSPSWAGAFQVLDGALHGYQRHPLRGLREHAMRRAAEWIVARQEADGSWGGIQPPWVYSLLALHLLGYPLDHPVLRQGLAGLERFLIREETPEGTVRRLEACQSPVWDTVLSMQALRDAGLAADHPALRRAADFVLAEEIRVKGDWSVRRPDLAPGGWAFEFDNDGYPDIDDTAEVVLALNRVDHERPGAVNAAIDRGVRWMSGMQSADGGWGAFDADNTRELVNELPFCDFGAVIDPPSADVTAHVVEALCVLGRGDGEAVRRGVRWLLDHQELDGSWFGRWGANHVYGTGAAVPALVRAGLRRDHLALRRAVRWLEVHQNDDGGWGEDLRSYDDPVWVGRGRSTASQTAWALLALLAVDLHDTDAVRRGVGFLAETQRPDGTWDEPQFTGTGFPGDFYINYHLYRLVFPVTALGRYEQARREQSGGSG

SEQ ID NO: 218 - protein, 656 aa, Schizosaccharomyces japonicus
MKTDGNTTLDTTISMEELERTVKSAYEALAKDQQDDGHWIYELEADVTIPAQFILLEHTLDKIDEELEQKIANYLRRCQSREHWGWPVYYGGEFNISASVQAYFALKMTGEDINAPHMVRAREAILAHGGPEYANVFTRIQLSLFGEASWLATPFMPVEIMLLPRWMYFSIWNMSYWSRTTVAPLLIVADLKPKAINPRNVHIPELFPTPPDKVKTWIHGPFRSKWGHVFKFIDTAIRPFTRFVPSFLHKKAYKAALDFIEPRLNGVDGLGAIYPPMSYSAVMYRALGIPDDDPRAATNWEALKGLLVIKEREAYCQACVSPVWDTALSGHALMEASFGPDGINADRTEKLIDRAAHWLRAHQVLNVVGDWAINNPNLQPGGWAFQYGNDYYPDVDDTAVAAMLLHRQNLPENEEALDRARKWIIGMQSSNGGWGAFDIDNDKQILNDIPFADHGALLDPPTADVSARCISLLAELGHPEDRPVIERGIKYLRKEQEEDGSWFGRWGTNYIYGAWSVLCAFNASGVPHDDPSVLKCVNFLKSVQREDGGWGESCETYEGSAHGVYTESLPSQTAWAVLGLMASGRRTDPAVKRGIVWLIQHQQDNGEWAEEPFNAVGFPRMFYLHYLGYKQFFPLLALARYRHMEKSGTNNVSFAF

SEQ ID NO: 219 - protein, 617 aa, Sphaerobacter thermophilus
MDPALSRAVDWLLEHQDPAGWWCGEFETNVTITAEHILLLRFLGLDPSPLRDAVTRYLLGQQREDGSWALYYEGPADLSTSIEAYAALKVLGLDPTSEPMRRALQVIHDLGGVAQARVFTRIWLAMFGQYPWDGVPSMPPELIWLPPSAPFNLYDFACWARATITPLLIILARRPVRPLGCDLGELVLPGSEHLLTRVPGSGPFWWGDKVLKRYDHLVRHPGRDRACQRIVEWIIARQEADGSWGGIQSAWVMSLIALHLEGLPLDHPVMRAGLAGFDRVALEDERGWRLQASTSPVWDTAWAVLALRRAGLPREHPRLALAVDWLLQEQIPGGGDWQVRTGTIPGGGWAFEFDNDHYPDIDDTAVVVLALLEAGHEDRVRNAVERAARWILAMRSTDGGWGAFDRDNAREVIHRLPIADFGTLIDPPSEDVTAHVLEMLARLSFPSTDPVVARGLEFLQQTQRPDGAWFGRWGVNYIYGTWCAVSALTAFADTDATARAMVPRAVAWLLDRQNADGGWGETCGSYEDPNLAGVGRSTPSQTAWAVLALQAAGLGQHPACRRGLDFLRERQVGGTWEEREHTGTGFPGDFFINYHLYRHVFPTMALAGAATGMDSPR

SEQ ID NO: 220 - protein, 583 aa, Streptomyces albus
FLGIRDEATTRSAALFIRGEQREDGTWATFHGGPPDLSTTVEAYVALRLAGDSPDAPHMTRAAHWVRSQGGIAEARVFTRIWLALFGWWPWDRLPELPPELIFLPPWAPLNIYDFGCWARQTIVPLTVVSAKRPVRPAPFPLDELHTDPADPAPRARFAPLASWNGAFQRLDRALHAYRKVAPRALRRAAMATAGRWIVERQENDGCWGGIQPPAVYSMIALHLLGYDLGHPVMRAGLESLDRFTLTREDGSRMVEACQSPVWDTCLATIALADAGVPADHPQLVRAADWMLDEQIERPGDWSVRRPHLAPGGWAFEFHNDNYPDIDDTAEVVLALRRVRHPDTARMERAISLGVRWNLGMQSKNGAWGAFDVDNTSSLPNRLPFCDFGEVVDPPSADVTAHVVEMLAAEGLAADPRTRRAVDWLLAEQEPSGAWFGRWGVNYLYGTGSAVPALVDAGLPTTHPAIRRAVAWLESVQNDDGGWGEDLRSYREQGRMARGASTASQTGWALMALLAAGERESRAARRGVTFLAETQHEDGSWEEPYYTGTGFPWDFSINYHLYRQVFPLTALGRYTRGAAPEGA

SEQ ID NO: 221 - protein, 666 aa, Streptomyces avermitilis
MTATTDGSTGALPPRAASASEPHDTIPQAAGSVGIQDAAARATQRATDFLLSRQDAEGWWKGDLETNVTMDAEDLLLRQFLGIQDEKTTRAAGLFIRGEQRADGTWATFYGGPGDLSATIEAYVALRLAGDGPDEPHMAKASAWIRERGGIASARVFTRIWLALFGWWKWDDLPELPPELIYFPKWMPLNIYDFGCWARQTIVPLTVVSAKRPVRPAPFPLDELHADANDPNPAKPLAPMVSWDGLFQRLDVALHTYRKVAPRRLRKAAMNTAARWIIERQENDGCWGGIQPPAVYSVIALYLLGYDLEHPVMREGLASLDRFAVWRDDGARMIEACQSPVWDTCLATIALADAGVPADHPQLVRAADWMLGEEIVRPGDWAVKRPQLPPGGWAFEFHNDNYPDIDDTAEVVLALRRVKHHDPERLDNAIRRGVRWNLGMQSKDGGWGAFDVDNTSPFPNRLPFCDFGEVIDPPSADVTAHVVEMLAFEGLSHDPRTRRGIQWLLSAQEANGSWFGRWGVNYVYGTGSVVPALVAAGLPASHPAIRRAVTWLETVQNDDGGWGEDLRSYPEAAEWSGKGASTASQTGWALLALLAAGERESKAVERGIEWLAQTQRPDGSWDEPYFTGTGFPWDFSINYHLYRQVFPLTALGRYVNGEPLVEVKGG

SEQ ID NO: 222 - protein, 639 aa, Acaryochloris marina
MAVRDRVNPKTLEAAIAASQSYLLTQQDETGYWWAELESNVSITSEVVLLHKIWGTDRSRPLEKVETYLRSQQRDHGGWELYFDDGGEISVSVEAYMALKLLGVPMEDPAMVRARQFILEHGGISRTRVFTKLHLALIGCYEWRGIPSLPPWVMLLPEQFPFTIYEMSSWARGSTVPLLIVMDREPVYAVEAGFNLDELYVEGRHRAQFDLPLSNEWTDAFIYLDGLFKFAESTNLVPFREEGIRAAERWILERQEATGDWGGIIPAMLNSLLGLKALDYDVHDPIIERGMAALDAFALETEDQYWIQPCISPVWDTALVVRGLAESGLAPDHPALVKAGEWLLNKQILDYGDWSVKNPGGLPGGWAFEFDNRFYPDVDDTAVVVMALNEVQLPDEQAKDAAIARAVNWIATMQCRPGGWAAFDINNDQDWLNALPYGDLKAMIDPNTADVTARVLEMIGRCHQTTGKNSVDRALRYLRTEQEPEGCWFGRWGVNYIYGTSGVLAALALIDPQGWQSQIQQAAAWLVSCQNTDGGWGETCASYDNPKLKGQGPSTASQTAWAIMGLLSAGEATSVYAEAAIERGVNYLTTTQKMDGTWDEDYFTGTGFPGHFYLKYHLYQQHFPLTALGRYQAMLQQKS

SEQ ID NO: 223 - protein, 666 aa, Streptomyces filamentosus
MTATTDGSTGAANITGAPADDPTDTRTAANDVTDIARRAAERSVEHLLGRQDEQGWWKGDLATNVTMDAEDLLLRQFLGIQDPATTRAAALFIRGEQLGDGTWNTFYGGPGDLSATIEAYVALRLAGDRPDEPHMARASGWIRDQGGIAAARVFTRIWLALFGWWKWDDLPELPPELMFFPKWVPLNIYDFGCWARQTIVPLTIVSAKRPVRPAPFALDELHTDPDHPNPPRKLAPPTSWDGLFQRLDKGLHLYHKVAPRPLRRIAMNVAARWIIERQENDGCWGGIQPPAVYSVIALHLLGYDLDHPVMKAGLASLDRFAVHREDGARMIEACQSPVWDTCLATIALADAGLRPDHPALVKAADWMLAEEITRPGDWSVRKPELAPGGWAFEFHNDNYPDIDDTAEVVLALRRVRHPDPARLEAAIARGVRWNLGMQSRNGAWGAFDADNTSPFPNRLPFCDFGEVIDPPSADVTGHVVEMLAVEGLANHPRTREGIEWLLAEQEACGAWFGRWGVNYVYGTGSVVPALITAGLPAGHPAIRRAVDWLESVQNDDGGWGEDLRSYQEEKWIGHGESTASQTAWALLALLAAGRRDTASVTRGVTWLTEAQQADGSWDEPYFTGTGFPWDFSINYHLYRQVFPLTALGRYVHGDPFADRTDAAEGV

SEQ ID NO: 224 - protein, 670 aa, Streptomyces flavogriseus
MTATTDGSTGAANLRAAAASDPTESTSAAPDMMAVARHAAERSVEHLLGRQDEQGWWKGDLATNVTMDAEDLLLRQFLGIQDPETVKAAARFIRGEQLGDGTWNTFYEGPPDLSATVEAYVALRLAGDRPDDPHMIRAAGWVREQGGIAESRVFTRIWLALFGWWKWDDLPELPPELMFFPKWVPLNIYDFGCWARQTIVPLTIVSAKRPVRPAPFALDELHTDPACPNPSRPTAPAASWDGVFQRLDKALHLYHKVAPRRLRRIAMNEAARWIIERQENDGCWGGIQPPAVYSVIALHLLGYDLDHPVMRAGLESLDRFAVWREDGARMIEACQSPVWDTCLATIALADAGVSPDHPALVRAADWMLGEEIVRPGDWAVRKPGLAPGGWAFEFHNVNYPDIDDTAEVALALRRVRHPDPARVDAAIERGVRWNLGMQSRNGAWGAFDADNTSPFPNRLPFCDFGEVIDPPSADVTGHVVEMLAVEGRAHDPRTRRGVEWLLAEQEASGAWFGRWGVNYIYGTGSVVPALIAAGLPAAHPSVRRAVDWLRSVQNDDGGWGEDLRSYREEKWIGHGSSTASQTGWALLALLAAGERETRSVERGVAWLAATQQADGSWDEPHFTGTGFPWDFSINYHLYRQVFPLTALGRYVYGDPFATATAIGAGTGKGA

SEQ ID NO: 225 - protein, 686 aa, Streptomyces ghanaensis
MTATTDGSTGAALPPRVTAASDTDTDIPVAAGVPDIAARAMRRATDFLLSRQSDQGWWKGDLETNVTMDAEDLLLRQFLGIRDEGTTRAAALFIRGEQREDGTWATFHGGPGDLSATIEAYVALRLAGDPPDAPHLARASAWIREQGGIAASRVFTRIWLALFGWWKWEDLPELPPELIWFPAWVPLNIYDFGCWARQTIVPLTIVSAERPVRPAPFPLDELHTDPARPNPPRALAPVTGWDGAFQRLDKALHVLRGAVPRRLRRAAMNTAARWIIERQENDGCWGGIQPPAVYSIIALHLLGYDLNHPVMRAGLESLDRFAVWREDGARMIEACQSPVWDTCLATIALADAGLPADHPQLVKAADWMLGEQIVRPGDWSVRRPHLPPGGWAFEFHNDNYPDIDDTAEVVLALRRVAHHDPERVDNAIGRGVRWNLGMQSRNGAWGAFDVDNTSPFPNRLPFCDFGEVIDPPSADVTAHVVEMLAAEGLAHDPRTRRGVQWLLAEQEPNGSWFGRWGVNYLYGTGSVVPALTAAGISGSHPAIRRAVAWLESVQNDDGGWGEDLRSYRDARGWSGRGASTASQTAWALMALLAAGERESRAVERGVEWLAATQHEDGSWDEPYFTGTGFPWDFSINYHLYRQVFPLTALGRYVNGEPLAGKPRAAGAATAREDTGQEQSLAEAKGS

SEQ ID NO: 226 - protein, 680 aa, Streptomyces griseoflavus
MTATTDGSTGAALPPRVTAASENDTDIPEAAGVPDIAAHAMRRATDFLLSRQDDQGWWKGDLETNVTMDAEDLLLRQFLGIRDEDTTRAAALFIRGEQREDGTWATFHGGPGELSTTIEAYVALRLAGDPPEAPHMARASAWIRERGGIAAARVFTRIWLALFGWWKWEDLPELPPELIWFPSWVPLNIYDFGCWARQTIVPLTIVSAKRPVRPAPFPLDELHTDPRRPRPPRPHAPPNTWDGAFQRLDRALHALRRAVPRRVRQAAMNAAARWIIERQENDGCWGGIQPPAVYSVIALHLLGYDLRHPVMRAGLESLDRFAVWREDGARMIEACQSPVWDTCLAAIALADAGLPADHPSLVKAADWMLGEQIVRPGDWSVRRPHLPPGGWAFEFHNDNYPDIDDTAEVVLALRRVRHHDPERMDSAIGRGVRWSLGMQSKNGAWGAFDVDNTSPFPNRLPFCDFGEVIDPPSADVTAHVVEMLAVEGLAHDPRTRRGIQWLLAEQEPDGSWFGRWGVNYLYGTGSVVPALAAAGIPGSHPAIRRAVAWLEKVQNDDGGWGEDLRSYRHVREWSGRGASTASQTAWALMALLAAGERDSGAVERGVAWLAATQREDGSWDEPYFTGTGFPWDFSINYHLYRQVFPLTALGRYVHGEPFSKKQTAARNGSAQPLAGVKGSR

SEQ ID NO: 227 - protein, 666 aa, Streptomyces griseus
MTATTDGSTGAANPSEATAHDPTDTTTAADDLTVAARRAAERSVEHLLGRQDEQGWWKGDLATNVTMDAEDLLLRQFLSIQDPETTRAAALFIRGEQLGDGTWNTFYGGPGDLSATIEAYVALRLAGDRPDEPHMARAAGWIRDQGGIAAARVFTRIWLALFGWWKWDDLPELPPELMFFPKWVPLNIYDFGCWARQTIVPLTIVSAKRPVRPAPFALDELHTDPDHPNPPRKLAPPTSWDGLFQRLDKGLHLYHKVAPRPLRRVAMNLAARWIIERQENDGCWGGIQPPAVYSVIALHLLGYDLDHPVMKAGLASLDRFAVRREDGARMIEACQSPVWDTCLATIALADAGLRPDHPALVKAADWMLAEEITRPGDWSVRKPELAPGGWAFEFHNDNYPDIDDTAEVVLALRRVRHPDPARLQAAIDRGVRWNLGMQSRNGAWGAFDADNTSPFPNRLPFCDFGEVIDPPSADVTGHVVEMLAVEGLASHPRTREGIEWLLAEQEACGAWFGRWGVNYVYGTGSVVPALITAGLPAGHPAIRRAVAWLESVQNDDGGWGEDLRSYQEEKWIGHGESTASQTAWALLALLAAGRRDTRPVARGVTWLTEAQQADGSWDEPYFTGTGFPWDFSINYHLYRQVFPLTALGRYVHGDPFADRAMAAEGA

SEQ ID NO: 228 - protein, 630 aa, Streptomyces hygroscopicus
MLARRATDRAVRHLLSRQDEQGWWKGDLETNVTMDAEDLMLRHFLGIQNPDVLDAAGRYIRSQQAADGTWATFHGGPPELSATVEAYVALRLAGDPPDAPHMAAASAWVRNNGGVASSRVFTRIWLALFGWWRWEDLPELPPEIIYFPPWLPLNLYDFGCWARQTIVPLTVVSAKRPVRPAPFSLDELHADPRRPNPPRPAAPLASWDGAFQRLDRALHLYRKVALRPLRRAALRSCARWIVERQENDGCWGGIQPPAVYSVIALHLLGYDLDHPVMRAGLESLDRFAVWREDGSRMIEACQSPVWDTCLAVIALADAGLAPDHPALVKSADWMLAEEIDRPGDWSVKRPRLAPGGWAFEFDNDNYPDIDDTAEVILALRRVDHPRPERIAAAVRRGVRWTLGMQSRNGAWGAFDVDNTSPLPNRLPFCDFGEVIDPPSADVTAHVVEMLAHEGGARDPRTRRAVGWLLAEQEPSGAWFGRWGTNYVYGTGSVVPALVAAGLPATHPAIRRAVRWLESVQNEDGGWGEDQRSYPDPEWIGHGASTASQTAWALLALLAAGERESKAVERGVGWLAATQDQDGSWDEPYFTGTGFPWDFSINYHLYRLVFPLTALGRYVSGEATGARPRRT

SEQ ID NO: 229 - protein, 680 aa, Streptomyces lividans
MTATTDGSTGASLRPLAASASDTDITIPAAAAGVPEAAARATRRATDFLLAKQDAEGWWKGDLETNVTMDAEDLLLRQFLGIQDEETTRAAALFIRGEQREDGTWATFYGGPGELSTTIEAYVALRLAGDSPEAPHMARAAEWIRSRGGIASARVFTRIWLALFGWWKWDDLPELPPELIYFPTWVPLNIYDFGCWARQTIVPLTIVSAKRPVRPAPFPLDELHTDPARPNPPRPLAPVASWDGAFQRIDKALHAYRKVAPRRLRRAAMNSAARWIIERQENDGCWGGIQPPAVYSVIALYLLGYDLEHPVMRAGLESLDRFAVWREDGARMIEACQSPVWDTCLATIALADAGVPEDHPQLVKASDWMLGEQIVRPGDWSVKRPGLPPGGWAFEFHNDNYPDIDDTAEVVLALRRVRHHDPERVEKAIGRGVRWNLGMQSKNGAWGAFDVDNTSAFPNRLPFCDFGEVIDPPSADVTAHVVEMLAVEGLAHDPRTRRGIQWLLDAQEADGSWFGRWGVNYVYGTGSVIPALTAAGLPTSHPAIRRAVRWLESVQNEDGGWGEDLRSYRYVREWSGRGASTASQTGWALMALLAAGERDSKAVERGVAWLAATQREDGSWDEPYFTGTGFPWDFSINYNLYRQVFPLTALGRYVHGEPFAKKSRAADAPAEAAPAEVKGS

SEQ ID NO: 230 - protein, 674 aa, Streptomyces peucetius
MTATTDGSSGPLRGGAATAGETTSTSAARTTEPGTDLREAAARAAERAVEHLLARQDAEGWWKGDLETNVTMDAEDLLLRQFLGIQDPATVGASARFIRGQQRDDGTWATFYGGPGELSTTVEAYVALRLAGDRPDDPHMQRAASWVRSRGGIAASRVFTRIWLALFGWWKWEDLPELPPELIFLPKWFPLNIYDFGCWARQTIVPLTVVSAKRPVRPAPFALDELHTDPALPNPGKRLAPAASWDGFFQRADKALHAYHKVAPRRLRRAAMNAAARWIIERQENDGCWGGIQPPAVYSVIALHLLGYDLEHPVMRAGLESLDRFAVHHEEEGLPVRMIEACQSPVWDTCLATIALADAGLPADHPALVKAADWMLSEQIVRPGDWSVRRPGLGPGGWAFEFHNDNYPDIDDTAEVVLALRRVKHPDPERVDAAVARGTRWNLGMQSRDGAWGAFDADNTSPFPNRLPFCDFGEVIDPPSADVTAHVVEILAHEGMAHDPRTRRGVRWLLAHQEANGAWFGRWGVNYVYGTGAVVPALTAAGLPGSHPAIRRAVAWLESVQNEDGGWGEDLRSYREEKSIGRGVSTASQTGWALLALLAAGERESKAVERGVAHLAQTQAPDGSWDEPYFTGTGFPWDFSINYHLYRQVFPLTALGRYVHGEKLPGRAGAREGR

SEQ ID NO: 231 - protein, 674 aa, Streptomyces pristinaespiralis
MTATTDGSSGPVRAGAATAGDTTTTTAARTTAPGTDVREAAGRAAERAVEHLLARQDAQGWWKGDLETNVTMDAEDLLLRQFLGIQDAATVEASARFIRGQQRDDGTWATFYGGPGELSTTIEAYVALRLAGDRPDDPHMQRAASWVRSRGGIAAARVFTRIWLALFGWWKWDDLPELPPELILLPKWVPLNIYDFGCWARQTIVPLTVVSAKRPVRPAPFALDELHTDPAMPNPQKRFAPAASWDGFFQRADKALHLYHKVAPRRLRRAAMNAAARWIIERQENDGCWGGIQPPAVYSVIALHLLGYDLEHPVMRAGLESLDRFAVHREEEGLPVRMIEACQSPVWDTCLATIALADAGLPADHPALVKAADWMLSEQIVRPGDWAVRRPGLGPGGWAFEFHNDNYPDIDDTAEVILALRRVKHPDPERVEAAVARGTRWNLGMQSLNGAWGAFDADNTSPFPNRLPFCDFGEVIDPPSADVTAHVVEMLAHEGMAEDPRTRRGVRWLLREQEANGAWFGRWGVNYVYGTGAVVPALIAAGLPASHPSVRRAVTWLESVQNEDGGWGEDLRSYREEQSIGRGASTASQTGWALLALLSAGERDGRAVERGVAWLARTQRPDGSWDEPYFTGTGFPWDFSINYHLYRQVFPLTALGRFLHGEKPVGRAAAREGG

SEQ ID NO: 232 - protein, 664 aa, Streptomyces scabiei
MTATTDGSTGALPPRAPSASDTDHGTPVAAGVQEAALHAVGRATDFLLSRQDAQGWWKGDLETNVTMDAEDLLLRQFLGIRDDATTRAAALFIRGEQRPDGTWATFYGGPPDLSATVEAYVALRLAGDDPAAPHMAKASAWIRARGGIAAARVFTRIWLALFGWWKWDDLPEMPPEIVYFPTWMPLNIYDFGCWARQTIVPLTVVSAKRPVRPAPFPLDELHTDPGRPNPPRPLDRLGSWEGAFQRLDRALHGYHKVALKRLRRAAMNRAARWIVERQENDGCWGGIQPPAVYSVIALHLLGYDLGHPVMRAGLESLDRFAVWREDGARMIEACQSPVWDTCLATIALADAGLPPDHPQLVKAADWMLGEEIVRPGDWSVKRPQLPPGGWAFEFHNDNYPDIDDTAEVVLALRRVRHPDPERVERAVRRGVRWTLGMQSGNGAWAAFDADNTSPFPNRLPFCDFGEVIDPPSADVTAHVVEMLAAEGLSHDPRTRRGIEWLLAEQEPGGAWFGRWGVNYVYGTGSVVPALVTAGLPAAHPAIRRAVAWLETVQNDDGGWGEDLRSYPDPAEWGGKGASTASQTAWALLALLAAGERDGKATERGVAWLARTQREDGSWDEPYFTGTGFPWDFSINYHLYRQVFPLTALGRYVHGEPAVLKPGTR

SEQ ID NO: 233 - protein, 684 aa, Streptomyces sp.
MRRRRSPRGPGAGPEADYGPARASAPDRLRGDAARGDAARRVQDATARAIRNLLGRQDPAGWWKGDLETNVTMDAEDLLLRQFLGIRDEAVTQAAALFIRREQREDGTWATFHGGPPELSATIEAYVALRLAGDAPDAPHMATASAWIRAHGGLAAARVFTRIWLALFGWWDWENLPELPPELVLLPPWVPLNIYDFGCWARQTIVPLTVVSAMRPVRPAPFALDELHTDARVPVPPRRMAPPTTWNGAFQWMDRALHVYRRFAPRRLREAAMASAGRWIIERQENDGCWGGIQPPAVYSVIALHLLGYDLGHPVMRAGLESLDRFAVWREDGSRMIEACQSPVWDTCLAAIALADAGVRPDHPALVKAADWMLGEEIVRTGDWAVRRPGLAPGGWAFEFHNDTYPDIDDTAEVVLALRRIRHPDPARVEAAIARGVSWNLGMQSRGGAWGAFDADNTSPFPNRLPFCDFGEVIDPPSADVTAHVVEMLAAEGRAADPRTRRGIAWLLAEQEPEGPWFGRWGTNYVYGTGSVVPALTAAGLSPGHPAIRRAVLWLESVQNPDGGWGEDQRSYQDRAWAGKGESTPSQTAWALMALLSAGERDAKTVERGIAYLVETQLADGGWDEPHFTGTGFPWDFSINYHLYRHVFPLTALGRYLYGEPFGHDGRHIGAHLGDRTGVPAEGV

SEQ ID NO: 234 - protein, 665 aa, Streptomyces sp.
MHEGEAMTATTDGSTGAATPPATTASAPLHLSPEARETHEATARATRRAVDFLLARQSDEGWWKGDLATNVTMDAEDLLLRQFLGIRDEATTRAAALFIRGEQQEDGTWNTFYGGPGDLSATIEGYVALRLAGDSPEAPHMRKASAFVRAQGGVARARVFTRIWLALFGWWKWEDLPEMPPELMFFPKWAPLNIYDFGCWARQTIVPLTVVCAQRPVRPAPFALEELHTDPADPDPAQPAPPVVSWDNVFHKLDKLLHGYRRIAPRRVREAAMRAAATWIVERQENDGCWGGIQPPAVYSIMALNLLGYDLDHPVLRAGLASLDRFAVWREDGARMIEACQSPVWDTCLATVALADAGVPADHPQMIKAADWMLAEQIVRPGDWVVRRPDLPPGGWAFEFHNDNYPDIDDTAEVVLALRRVAHPDATRVDKAVRRAVDWNVGMQSKNGAWGAFDADNTSPFPNRLPFSDFGEVIDPPSADVTAHVVEMLAEEGLAHHPRTRRGIEWLLKNQEGNGSWFGRWGVNYVYGTGAVVPALVAAGLPASHPAIRRSVSWLGQVQNEDGGWGEDLRSYQDSAWHGRGHSTASQTAWALLALLAAGERETEQVRRGIAYLVETQTEDGTWDEPWFTGTGFPWDFTINYHLYRQVFPVTALGRYLNGTGPGEN

SEQ ID NO: 235 - protein, 636 aa, Streptomyces sp. AA4
MTQTVPRTAASAPAARTAADTVAAAVQFLRREQDRAGWWKGELATNVTMDAEDLLLRHFLGILTPQIAEESARWIRSQQRADGTWANFPDGPADLSTTVEAWVALRLAGDPADAPWLATAAEWIREHGGIEATRVFTRIWLAMVGQWSWDDLPSLPPELIFLPSWFPLNVYDFACWARQTIVPLTIVGTLRPARKLPFDVAELRTGKRPPKPRAPWTWDGVFQNLDTALHAYAKLPLNPVRKLALKQAAEWILARQEADGSWGGIQPPWVYSILALHLLGYSLDHPALKAGIAGLDGFTIREKTDQGWVRRLEACQSPVWDTALAMTALLDAGVSPGDESLVRAAEWMLGEEIRVPGDWAVRRPSLKPGGFAFEFANDGYPDTDDTAEVVLALRRMGKPDHLRIREAVDRSVAWLEGMQSSDGGWGAFDADNTQVLTTRLPFCDFGAVIDPPSADVTAHVVEMLAAEGKADTRECRRGIRWLWDNQEADGSWFGRWGANYVYGTGAVVPALVAAGVPGTDPRIRRAVRWLAEHQNDDGGWGEDLRSYDDRSWAGRGDSTPSQTAWALLALLAAGERESTVVARGVEWLCERQRPDGGWDEDKHTGTGFPGDFYLSYHLYRVVFPLSALGRYVRGGS

SEQ ID NO: 236 - protein, 676 aa, Streptomyces sp. C
MTATTDGGGAITGGADPRHDSTAAPAAAAAGPSGGGTGLPEGVREAVDRATAELLARQDPAGWWKGDLQTNVTMDAEDLLLRQFLGIRDEAVTRAAALFIRGEQQGDGTWATFHGGPPELSATIEAYVALRLAGDPPDAPHMTRASAWIRAHGGIAAARVFTRIWLALFGWWSWDRLPELPPELVFLPPWVPLNIYDFGCWARQTIVPLTVVSALRPVRSAPFALDELHTDARDPVPAKPLPPLASWDGAFQRMDKALHLYRRVAPRRLRKAAMAAAGRWIVERQENDGCWGGIQPPAVYSVIALHLLGYDLGHPVMRAGLESLDRFAVWREDGARMVEACQSPVWDTCLAAIALADAGLPPDHPALVRAADWMLGEEIRRPGDWAVRRPGLAPGGWAFEFHNDNYPDIDDTAEVVLALRRIRHPQPGGVEAAIARGVSWTLGMQSKNGAWGAFDADNTSPFPNRLPFCDFGEVIDPPSADVTAHVVEMLAAEGRAADPRARRGIAWLLAEQEPDGPWFGRWGTNYVYGTGSVVPALTAAGIAPSHPAVRRAVRWLESVQNEDGGWGEDQRSYRDRSWAGKGASTASQTAWALMALLSAGERDGDAVARGLAYLVETQRPDGTWDEPYFTGTGFPWDFSINYHLYRQVFPLTALGRYLHGEPFGPERRNVPPAGES

SEQ ID NO: 237 - protein, 684 aa, Streptomyces sp. Mg1; identical to SEQ ID NO: 233

SEQ ID NO: 238 - protein, 665 aa, Streptomyces sp. SPB74; identical to SEQ ID NO: 234

SEQ ID NO: 239 - protein, 606 aa, Streptomyces sp. SPB78
MDFLLDRQSDEGWWKGDLATNVTMDAEDLLLRQFLGIRDEATTQAAALFIRGEQQEDGTWNTFYGGPGDLSATIEGYVALRLAGDSPEAPHMRKASAFVRARGGVARARVFTRIWLALFGWWKWEDLPEMPPELMFFPKWAPLNIYDFGCWARQTIVPLTVVCAQRPVRPAPFALEELHTDPADPNPAQPAPPVASWDNVFHKLDKMLHGYRKVAPRRVREAAMRAAATWIVERQENDGCWGGIQPPAVYSIIALHLLGYDLDHPVLRAGLESLDRFAVWREDGARMIEACQSPVWDTCLATVALADAGVPADHPQMIRAADWMLAEQIVRPGDWVVRRPDLPPGGWAFEFHNDNYPDIDDTAEVVLALRRVAHPDATRVDKAVRRAVDWNAGMQSKNGAWGAFDADNTSPFPNRLPFSDFGEVIDPPSADVTAHVVEMLAEEGLAHHPRTRRGIEWLLENQEANGSWFGRWGVNYVYGTGAVVPALVAAGIPAAHPAIRRSVSWLGQVQNEDGGWGEDLRSYQDTAWHGRGHSTASQTAWALLALLAAGERDSEQVRRGIAYLVETQTEDGTWDEPWFTGTGFPWDFTINYHLYRQVFPVTALGR

SEQ ID NO: 240 - protein, 669 aa, Streptomyces sviceus
MHEGEAMTATTDGSTGALPPRAAAASETHLDTPVAAGIQEAAVRAVQRATEHLLARQDAEGWWKGDLETNVTMDAEDLLLRQFLGIRDESTTRAAAKFIRGEQREDGTWAGFYGGPGELSTTVEAYVALRLDGDAPDAPHMAKASAWIRAQGGIAAARVFTRIWLALFGWWKWEDLPELPPELIYFPKWAPLNIYDFGCWARQTIVPLTIVSAKRPVRPAPFPLDELHADPADPNPAKPLAPVASWDGAFQRLDKAMHQLRKVAPRRLRRAAMNSAARWIIERQENDGCWGGIQPPAVYSVIALHLLGYDLQHPVMRAGLESLDRFAIWREDGSRMIEACQSPVWDTCLATIALVDAGVPADHPQLVKAADWMLGEEIVRPGDWSVKRPQLPPGGWAFEFHNDNYPDIDDTAEVVLALRRVRHHDPDRVENAIGRGVRWNLGMQSKNGAWGAFDVDNTSPFPNRLPFCDFGEVIDPPSADVTAHVVEMLAVEGLSHDPRTRRGIEWLLAEQEPDGSWFGRWGVNYIYGTGSVVPALTAAGLPASHPAIRRAVAWLEKVQNDDGGWGEDLRSYKYVKEWSGRGASTASQTAWALMALLAAGERDSKAVERGVEWLASTQRADGSWDEPYFTGTGFPWDFSINYHLYRQVFPLTALGRYVHGEPFSRTEAL

SEQ ID NO: 241 - protein, 664 aa, Streptomyces viridochromogenes
MTATTDGSTGALPPRADAASEHDIETPEAAGVREAAVRAARRATDFLLSRQDAQGWWKGDLETNVTMDAEDLMLRQFLGVLDEKTAQAAALFIRGEQREDGTWASFYGGPGELSTTIEAYVALRLAGDAPDSPHLAKASAWIREQGGIAAARVFTRIWLALFGWWKWEDLPELPPELIWFPKWVPLNIYDFGCWARQTIVPLTIVSAKRPVRPAPFPLDELHTDPARPNPPRPLAPAFSWDGAFQRMDKGLHALRKVAPRGLRRAAMNAAARWIIERQENDGCWGGIQPPAVYSIIALHLLGYDLQHPVMREGLASLDRFAVWREDGARMVEACQSPVWDTCLAAIALVDAGLPADHPQLVKAADWMLGEEIVRPGDWSVRRPGLPPGGWAFEFHNDNYPDIDDTAEVILALRRITHHDPVRVDKAVGRGVRWTLGMQSKNGAWAAFDVDNTSPFPNRLPFCDFGEVIDPPSADVTAHVIEMLAVEGLAHDPRTRRGIEWLLAEQEPDGSWFGRWGVNYVYGTGSVVPALVAAGLPGAHPAIRRAVSWLESVQNDDGGWGEDLRSYKYVKEWSGRGASTASQTAWALMALLAAGERDSKAVERGVEWLAATQREDGSWDEPYFTGTGFPWDFSINYHLYRQVFPLTALGRYVHGEPFADRLKGS

SEQ ID NO: 242 - protein, 653 aa, Synechococcus sp.
MSISALQTDRLSQTLTQSVVAAQQHLLSIQNPEGYWWANLESNASITAEVVLLHKIWGTLDSQPLAKLENYLRAQQKTHGGWELYWNDGGELSTSVEAYMGLRLLGVPASDPALVKAKQFILHRGGVSKTRIFTKFHLALIGCYRWQGLPSLPAWVMQLESPFPFSIYELSSWARGSTVPLLIVFDKKPVYPLQPSPTLDELFTESAENVRWELEEKGDWSDAFLWLDKAFKLAESVDLVPFREESIRKAEKWVLERQEPSGDWGGIIPAMLNSMLALRALGYSVSDPVVRRGFQAIDNFMVESETECWAQPCISPVWDTGLAVRSLTDSGLSPNHPALVKAGEWLLDKQILSYGDWSVKNPQGQPGGWAFEFENSFYPDVDDTAVVAMALQDITLPNEPLKRRAIARAVRWIATMQCKTGGWAAFDINNDQDWLNDIPYGDLRAMIDPSTADITGRVLEMHGRFAADLDLANSYAADLSPYRLSRGLNYLIKEQELDGSWFGRWGVNYIYGTGQALSALALIAPERCRIQIERGIAWFVSVQNADGGWGETCESYKDKSLKGKGISTASQTAWALLGLLDVSFCLDPAAKIAVDRGIQYLVSTQSEGTWQEESFTGTGFPQHFYLRYRLYCHYFPLMALGRYQRVINSSAGI

SEQ ID NO: 243 - protein, 653 aa, Synechococcus sp. PCC 7335; identical to SEQ ID NO: 242

SEQ ID NO: 244 - protein, 647 aa, Synechocystis sp.
MVIAASPSVPCPSTEQVRQAIAASRDFLLSEQYADGYWWSELESNVTITAEVVILHKIWGTAAQRPLEKAKNYLLQQQRDHGGWELYYGDGGELSTSVEAYTALRILGVPATDPALVKAKNFIVGRGGISKSRIFTKMHLALIGCYDWRGTPSIPPWVMLLPNNFFFNIYEMSSWARSSTVPLMIVCDQKPVYDIAQGLRVDELYAEGMENVQYKLPESGTIWDIFIGLDSLFKLQEQAKVVPFREQGLALAEKWILERQEVSGDWGGIIPAMLNSLLALKVLGYDVNDLYVQRGLAAIDNFAVETEDSYAIQACVSPVWDTAWVVRALAEADLGKDHPALVKAGQWLLDKQILTYGDWQIKNPHGEPGAWAFEFDNNFYPDIDDTCVVMMALQGITLPDEERKQGAINKALQWIATMQCKTGGWAAFDIDNDQDWLNQLPYGDLKAMIDPSTADITARVVEMLGACGLTMDSPRVERGLTYLLQEQEQDGSWFGRWGVNYLYGTSGALSALAIYDAQRFAPQIKTAIAWLLSCQNADGGWGETCESYKNKQLKGQGNSTASQTAWALIGLLDALKYLPSLGQDAKLTTAIEGGVAFLVQGQTPKGTWEEAEYTGTGFPCHFYIRYHYYRQYFPLIALARYSHLQAS

SEQ ID NO: 245 - protein, 688 aa, Syntrophobacter fumaroxidans
MNPIRGKRGSAADFLEEEYQWENLADHGESGRTPGGGHPAALKEYEAGSATEHTGHHCVHHLGVRNSWLRKIEKAIDNACGQLFKTQYEDGYWWSELESNVTITSEYIMLLYLLEVSRPEQQKSMVKYLLNQQRPDGSWGLYYGDGGNLSTTIEAYFALKLAGEHCESEPMRRAREFILSKGGIESARVFTKIWLALFSQYDWDKVPSMPVELVLLPSSLYFNIYEFSSWARGTVVPLSIVMSIRPRCPLPAKCSIKELYVPGSKHKNFASCTHKLFFLFDRIAKAFERRPVPSLRNKAVQAAETWVLDHQEDSGDWGGIQPPMVYSVLALYYLGYPLDHEVIVKGIKALDAFCMEDEEGTRMQSCVSPVWDTALTVLSMLDAGVAAEHPGLEKAGRWLLENQVLTGGDWQIKNDSLPGGWAFEFYNTRYPDVDDSAVVLSTLNRFNAERVEGLEFAKCRGMEWCLSMQSSNGGWAAFDKDNTLEILNRIPFADQEAMVDYPTADVTGRVLEAMGYLGYDGSHPRARKAIQFLKKRQERDGCWWGRWGVNYIYGTWSVLKGLISIGEDPRAAYIRAAVRWVKDHQNSDGGWGETCESYENPELRGQGPSTPSQTAWALMSLIACGEMKSQEASRGIQYLLRTQKRDGTWEELHFTGTGFPKHFYIRYHNYRNCFPLMALGQYLRALER

SEQ ID NO: 246 - protein, 710 aa, Syntrophobacter fumaroxidans
MRRLDTFPPEIPTGSRDKPPSGEEHSCSTPAEPLRSRLDEGILRAVDWLVCDQHPDGFWAGMLQSNSCMEAEWVLAMHFLGIDDDPKYDGVIRAILGEQRADGSWGVFHKAPNGDINTTVECYAALRASGLAPESAPLSSAREWILAGGGLANIRNFTKYWLALIGEWPWEGTPTIPPELIFFPPRMPLNIYHFASWARSTIVPLSILSARRPVRPLPEDRRLDELFPQGRSAFDFRLPRKDGWLSWEGFFHVCDRILRLYARTRRAPFRETAIRVCLEWIIRRQETDGAWSGIQPPWIYALLALHAEGYGLDHPILRAGLRAFDSHWSYERDGGIYLQASESPVWDTVLSLRALADCGEERKASVSIASALEWLLNRQISVPGDWAVRVPSVPCGGWAFQRANSFYPDVDDTAVAIEVLARLRPFTANQSAVDRAIRSARDWVLAMQCSNGGWAAFDRDNDFKLVTKIPFCDFGELLDPPSVDVTAHVIEALAALGWDMTSREIEAAVSFIRREQEAEGSWFGRWGVNHIYGTATVLPALRAIGEDMSSAYVLRAADWLASRQNADGGWGETPASYMDDSLRGVGESTASQTAWAIMGLVAVGSGAHDDTVRRGIDFLLFAQHGGTWEEPQYTGTGFPGYSVGERIRLRDMGASLKQGTELQRAFMINYNLYRHYFPLMALGRARYHLQLRRSAREGGNGETTPNGSAL

SEQ ID NO: 247 - protein, 671 aa, Teredinibacter turnerae
MEIQDEVDLLEPQESLTASADSAVDRALFWLLDAQYEDGYWAGILESNACMEAEWLLCFHVLGIANHPMSRGLVQGLLQRQRADGSWDVYYGARAGDINTTVEVYAALRCQGYAADHPDIKRARDWIQLQGGVKQVRVFTRFWLALIGEWPWEETPNLPPEILFFPRWFPFNIYHFAAWARATLVPLCILSARRMVVPLNKKSCLQELFPEDRSAVVALGKKAGAWSTFFYHADRALKKYQRTFKRPPGRQQAIKMCLEWILRRQDADGAWGGIQPPWIYSLMALKAEGYPVTHPVMAKGLAALDAHWSYERPGGARFVQACESPVWDTLLSSFALLDCGFSCTSSSELRKAVDWILDQQVLLPGDWQQKLPTVSPGGWAFERANVHYPDVDDTAVALIVLAKVRPDYPDTARVNLAIERGLNWLFAMQCRNGGWGAFDKDNDKDLLTKIPFSDFGETIDPASVDVTAHVLEALGLLGYRTTHPAVAKALEFIRSEQENDGCWFGRWGVNYIYGTAAVLPALASLNMNMNQEFIRRAANWILGKQNNDGGWGESCASYMDDTQRGRGPSTASQTAWAMMSLLAVDGGTYAESLLRAEAYLKTTQTPEGTWDEPYYTGTGFPGYGIGRREIKRQRSLQQHAELSRGFMINYNLYRHYFPLMALGRLAALRGA

SEQ ID NO: 248 - protein, 642 aa, Thermosynechococcus elongatus
MPTSLATAIDPKQLQQAIRASQDFLFSQQYAEGYWWAELESNVTMTAEVILLHKIWGTEQRLPLAKAEQYLRNHQRDHGGWELFYGDGGDLSTSVEAYMGLRLLGVPETDPALVKARQFILARGGISKTRIFTKLHLALIGCYDWRGIPSLPPWIMLLPEGSPFTIYEMSSWARSSTVPLLIVMDRKPVYGMDPPITLDELYSEGRANVVWELPRQGDWRDVFIGLDRVFKLFETLNIHPLREQGLKAAEEWVLERQEASGDWGGIIPAMLNSLLALRALDYAVDDPIVQRGMAAVDRFAIETETEYRVQPCVSPVWDTALVMRAMVDSGVAPDHPALVKAGEWLLSKQILDYGDWHIKNKKGRPGGWAFEFENRFYPDVDDTAVVVMALHAVTLPNENLKRRAIERAVAWIASMQCRPGGWAAFDVDNDQDWLNGIPYGDLKAMIDPNTADVTARVLEMVGRCQLAFDRVALDRALAYLRNEQEPEGCWFGRWGVNYLYGTSGVLTALSLVAPRYDRWRIRRAAEWLMQCQNADGGWGETCWSYHDPSLKGKGDSTASQTAWAIIGLLAAGDATGDYATEAIERGIAYLLETQRPDGTWHEDYFTGTGFPCHFYLKYHYYQQHFPLTALGRYARWRNLLAT

SEQ ID NO: 249 - protein, 632 aa, Trichodesmium erythraeum
MIEKNKVKQSILASQKHLLSLQETEGYWWGQLESNVTITAEIILLHKIWQTDKKIPLNKAKNYLISQQREHGGWELFYGDGGDLSTSIEAYMALRLLGVSRTDPIMIEAQNFIIKKGGISCSRIFTKLHLALIGCYSWQGIPSIPSSIMLLPEDFPFTIYEMSSWARSSTVPLLIVFDKKPIFSVNPTINLDELYAEGINNASFELPRKYDLTDLFLGLDKAFKFAENLNLMPLQQEGLKAAEKWILERQEVTGDWGGIIPAMLNSMLALKCLEYDVADPVVVRGLEAIDRFAIENEDSYRVQACVSPVWDTAWVIRSLVDSGISPSHPAMVKAGQWLLQQQILDYGDWVFKNKFGKPGGWAFEFMNRFYPDIDDTAVVVMALDVVELPDEDLKGKAIARGMEWIASMQCEAGGWAAFDVDNNQDWLNATPYGDLKAMIDPNTADVTGRVLEMVGCCGLAMDSWRVKRGIDFLVREQEEEGCWFGRWGVNYIYGTSGVILALAVMARESHRGYIERGASWLVGCQNSDGGWGESCWSYNDPSLKGKGKSTASQTAWALIGLLAAGEGTGNFARDAIDGGVGFLVSTQNDDGSWLEDEFTGTGFPGHFYIKYHFYSQYFPLMALGRYESLLSG

SEQ ID NO: 250 - protein, 233 aa, Unknown
  Uncultured organism
SPMWDTVLTTLAVQDAGVDQEPEFKPAMERTLEWLLKNEVRTGGDWQQKTRGVEPGGWAFEYANASYPDNDDTAVALIVLAPFRHDPKWQARGIQHVIDRAVNWMFAMQCDNGGWAAFDLDNDKAILTRIPFCDFGEALDPPSVDVTAHVLEALAALGYSREHPAVRRAIAFLKEDQEPDGSWFGRWGVNFIYGTAAALPALKAMDEDMTQDWITRAADWMRSRQNDDGGWGE

SEQ ID NO: 251 - protein, 233 aa, Unknown
  Uncultured organism
SPVWDTVLTMLSVQDCDADENSENAPAIEKAIEWLLANEVRTGGDWQEKVKGVEPGGWAFEYKNASYPDTDDTAVAMMALAPYRTEEKWKKKGLPEALKRAAEWNIAMQCSNGGWGAFDKDNDKTILCKIPFCDFGEALDPPSVDVTAHVLEGLAALDYPPEHPAIQRAVQFIKDEQEPDGSWWGRWGVNFIYGTAAALPALKAVGEDMRAPYIDRAAKWIVDHQNEDGGWGE

SEQ ID NO: 252 - protein, 231 aa, Unknown
  Uncultured organism
SPVWDTVLTLLALDDCGYNDCYSEEVDKAVQWVLDQQVLSKGDWSVKLPNVEPGGWAFEYANTRYPDTDDTAVALIVLSQFKDDPKWKERGINQAIERGVNWLFEMQCKNGGWGAFDKDNDKTLLTKIPFCDFGEALDPPSVDVTAHIVEAFGKLGYSKDHPKIAHAIEYLKEEQEADGAWFGRWGVNYVYGTGAVLPALEAIGEDMSQPYIRKAANWLVLHQNEDGGWGE

SEQ ID NO: 253 - protein, 231 aa, Unknown
  Uncultured organism
SPVWDTVLTLLAFDDCDKNEAYQASVEKAVQWTLDNQVLRKGDWSVKLPDVEPGGWAFEYANTFYPDTDDTAVALIVLSQFRDVEKWQEAGIEKAIERGVNWLFAMQSKNGGWGAFDKDNDNNFITKIPFCDFGEALDPPSVDVTAHCIEAFGKLGLSRARPEIARGLDYLKSEQEADGAWFGRWGVNYVYGTGAVLPALEAIGEDMSQPYIRKAANWLILRQNEDGGWGE

SEQ ID NO: 254 - protein, 231 aa, Unknown
  Uncultured organism
  Misc_feature (36)..(36): Xaa is any naturally occurring amino acid
SPVWDTLLTLLAYDDSGQNERKADEVEKAVDWVLAXQVLRPGDWKVKAPNLEPGGWAFEYANYFYPDTDDTAVALIVLSQFRNDAAWKEKGIEQAIEKGVNWLFGMQCKGGGWGAFDKDNDKQFLTKIPFCDFGEALDPPSVDVTAHIVEAFGKLKFSKDHPNIRRAIDYMKDEQEADGAWFGRWGVNYIYGTGAVLPALEAIGEDMFAPCIGRACDWLVSRQNDDGGWGE

SEQ ID NO: 255 - protein, 231 aa, Unknown
  Uncultured organism
SPVWDTLLTLLAYDNSGHNARKASEVEKAVDWVLAQQVLRPGDWNVKAPNLEPGGWAFEYANYFYPDTDDTAVALIVLSQFRNDAAWKDKGIEQAIEKGVNWLFGMQCKGGGWGAFDKDNDRQFLTKIPFCDFGEALDPPSVDVTAHIVEAFGKLKFSKDHPNIRRAIDYTKDEQEDDGAWFGRWGVNYIYGTGAVLLALEAIGEDMSAPYIGRACDWLVSRQNDDGGWGE

SEQ ID NO: 256 - protein, 231 aa, Unknown
  Uncultured organism
  Misc_feature (180)..(180): Xaa is any naturally occurring amino acid
SPVWDTLLTLLAIEDSGQSVKRAQEVEKAVDWVLSQQVLRPGDWKVRAPHLEPGGWAFEYANYFFPDTDDTAVALIVLSQFRNDAAWKAKGIETAIEKGVNWLLGMQCKGGGWGAFDKDNDKTYLTKIPFCDFGEALDPPSVDVTAHIVEAFGKLGFSKDHPNIARAIEYLKSEQESDGXWFGRWGVNYVYGVGAVLPALEAIGEDMSAPYIGRACDWLVSKQNSDGGWGE

SEQ ID NO: 257 - protein, 231 aa, Unknown
  Uncultured organism
  Misc_feature (7)..(7): Xaa is any naturally occurring amino acid
SPVWDTXLTLLALDDCDLNERQSKEVEKAVQWVLNQQVLRPGDWCVKVPKVQPGGWAFEYKNYFYPDTDDTAVALIVLSQFRDDPKWQEKNIEQAIDRGLNWLIGMQCKGGGWGAFDKDNDKTYLTKIPFCDFGEALDSPSVDVTAHIVEAFGKLGLGKSHPAMIRAIDYLKAEQEQDGAWFGRWGVNYIYGTGAVLPALEAIGEDMRAPYIAKACDWLIAVQQEDGGWGE

SEQ ID NO: 258 - protein, 231 aa, Unknown
  Uncultured organism
SPVWDTVLTMLAIHDCGADKQYAPQMDKAIDWLLANEVRHKGDWAVKLPDVEPGGWAFEYSNACYPDLDDTAVALIVLAPYRNDPKWQARDIEGAVERAVDWTLAMQCKNGGWGAFGKDNDKAILTKIPFCDFGEALDPPSVDVTAHVLEALAALGYDNSHPAVARAIRYLRDEQEPDGSWWGRWGVNYIYGTAAVLPALKAMGVDMNEPFVHKAADWIGSVQNEDGGWGE

SEQ ID NO: 259 - protein, 231 aa, Unknown
  Uncultured organism
SPVWDTVLTLLAMEDCEATEEHAAAIEQAIEWLLENEVRTPGDWQMKVPDADPGGWAFEYANAAYPDVDDTAVAILVLARYRDDPKWQAKGLPQAIDRAVAWVLAMQCSNGGWAAFDKDNDKSILCKIPFCDFGEALDPATVDVTAHVLEALAAVGYGPDHPAVRRGLDFLYAEQEADGSWWGRWGVNYVYGTGAALPAFKAIGADMRDPRMLKAADWILRCQNKDGGWGE

SEQ ID NO: 260 - protein, 231 aa, Unknown
  Uncultured organism
  Misc_feature (133)..(133): Xaa is any naturally occurring amino acid
SPVWDTVLTLLAIQDADKQDDMAAEVDRAIGWLLSKEVRTNGDWSVKLPDVEPGGWAFEHENARYPDTDDTAVAVMVLAPYRHHPKWRKRGLPEALDRAISWMRAMQCRNGGWGAFDKDNDNAFLCVIPFCDXGEALDPPSIDVTAHALEAFAAMGFGPEDTTVARALDYMSKEQEADGSWWGRWGVNYIYGTAAALPAYKAFGQDMRDPKLMKAADYLRAKQNADGGWGE

SEQ ID NO: 261 - protein, 231 aa, Unknown
  Uncultured organism
SPVWDTVLTLLAIQDADKQEEMAGEIDKAIGWLLSKEVRTKGDWSVKLPRVEPGGWAFEHENARYPDIDDTAVAIMVLAPYRDHPKWKKRGLPEALDRAIAWMRAMQCRGGGWGAFDKDNDKQILCTIPFCDFGEALDPPSIDVTAYALEAFAAMGYGPDDKTVARALKYMSKEQEADGSWWGRWGVNYIYGTAAALPAYKALGQDMRDPGLMKAADYLRDKQNADGGWGE

SEQ ID NO: 262 - protein, 231 aa, Unknown
  Uncultured organism
SPVWDTVLTLLAMQDADRTDKHKAAVDKAIQWVLDQEVRTPGDWCVQTPDVEPGGWAFEYENARYPDVDDTAVAIMVLAPYQDDPKWRKRGLPDALARAIAWIRAMQCKNGGWGAFDRDNDNSMLTVIPFCDFGEALDPPSVDVTAHALEAFHMMGYGPEDPTVARALAYLDAEQEQDGSWWGRWGVNFIYGTSAALPALKAMGRDMRDPRYTKAADYLRAVQNDDGGWGE

SEQ ID NO: 263 - protein, 231 aa, Unknown
  Uncultured organism
SPVWDTSLILNALLAGSEKTETDPKILKAGQWLLDREVREIGDWKIKNNRGPVGGWYFEYANEFYPDCDDTAEVITVLNQMQFSDPEKEKAKQVAQQRGLDWLLSMQNKDGGWPAFDKNCDKQSLTYMPFADHNAMIDPSYEDITGRTLEALASLGFSEDDPIVRRAVDFLKSKQLPDGTWYGRWGCNFLYGTWLAISGLYHAGEDLNEERYQSLLSWLEQCQNEDGGWGE

SEQ ID NO: 264 - protein, 230 aa, Unknown
  Uncultured organism
SPVWDTLLTLEALLDCNLSPKTFTGMQAAVDWILSKQIVTPGDWQIKVPGVSCGGWAFERANTFYPDMDDTAVAMIVLARIRRYYNDSSRIDRALACATDWILSMQCSNGGWAAFDLDNTNDLVTRIPFSDFGEMLDPPSVDVTAHVVEALGCLGRTRNDPAVARAVAYILDEQEPEGSWFGRWGVNHIYGTGAVLPALAAVGTDMSAGYITRAADWVATHQNADGGWGE

SEQ ID NO: 265 - protein, 230 aa, Unknown
  Uncultured organism
SPVWDTTNAMTAVLDAGLPGNHPAVLRAARWLLSKEVRMPGDWRLWYKNGEPGGWFFEYNNEFYPDADDTAEALHCLCRVVFDCEDEMDRCRAAIKRGLNWQFACQNPDGGWPAFDKECDDEYLTFIPFADHNAMIDPSCCDITGRSLQALSKLGYTTNDVDVKRAIDYLLDAQEDDGTWYGRWGINYIYGTWLAVQGLRAIGVDLSEKRFQKVTKWLRKKQNPDGGWGE

SEQ ID NO: 266 - protein, 230 aa, Unknown
  Uncultured organism
  Misc_feature (208)..(208): Xaa is any naturally occurring amino acid
  Misc_feature (224)..(224): Xaa is any naturally occurring amino acid
SPIWDTGIVLHSLVESGVSPDHEALLRSVSWLLAKEVTHEGDWKVKCPDAPVGGWYFEYANEFNPDCDDTAKVLMATSRFSSVDFPDAGRLRDARNRGLQWLLHMQNKDGGWAAFDKGCDNELLTYIPFADHNAMIDPSTEDITGRVLETLAREGFDNTHPVVKRAIQYLHKTQDAEGPWYGRWGSNFIYGTWLVLQGLKAVGEDMTXPRYQRAANWLLNVQNXNGSWGE

SEQ ID NO: 267 - protein, 230 aa, Unknown
  Uncultured organism
SPVWDTAISVIALAESGLHRGHPSLVQATEWLVANEIRRGGDWQVKNPTAPISGWAFEFKNDFYPDVDDTAMVLLALRHVHLYNDDVSQDREKSYLRGLNWMLSMQCKNGGWAAFDRDNVKTIFEKIPFADHNAMIDPPSVDITGRVLELLGYVGYDKSYPCVTKALEYIKKDQEADGSWYGRWGVNYIYGTWQVLRGLAAIGEDMQSEYVQKAVRWMKSVQNPDGGWGE

SEQ ID NO: 268 - protein, 229 aa, Unknown
  Uncultured organism
  Misc_feature (111)..(111): Xaa is any naturally occurring amino acid
SPVWDTCLILNSMLEHLEPDHPRVQKAAEWLLSKEVTEPGDWQVKCPEAPVGGWYFEYANEFYPDCDDTAEVLAALQRVQFTDADREAQKRGAIQRGLGWLLAMQNQDGGXAAFDRECTREALTYVPFADHNAMIDPSNGDITGRVLKALDYAGYSPDDPIVRGGVDFLLANQEPDGTWYGRWGCNHLYGSWLVVWGLKHAGVNLQQTQFTQVMSWLESCQNADGGWGE

SEQ ID NO: 269 - protein, 229 aa, Unknown
  Uncultured organism
SPVWDTCLILNSLLEHLEPDHPRLQHAAEWLLSKEVTEPGDWQVKCPEAPIGGWYFEYANEFYPDCDDTAEVLAALQRVRFSDADREAQKHAAIERGLGWLLAMQNGDGGWAAFDRECTREALTYVPFADHNAMIDPSNGDITGRVLKALDYSGRSPQDPVVQGGVHFLLANQEPDGTWYGRWGCNHLYGSWLAIWGLKHAGVDSQQSQFMRLLSWLESCQNPDGGWGE

SEQ ID NO: 270 - protein, 229 aa, Unknown
  Uncultured organism
SPVWDTALAMSALLEGDTAPDDEALQRGCRWLLGKEVRHRGDWQVNVGAEPGGWFFEYENEFYPDCDDTAEVLAVLERVRLSDPEEDQRRRDALDRALAWQLGMQSTNGGWGAFDKDCDHRILELVPFADHNAMIDPPTVDVTSRSIEAALAMGVPASDAAIRRAVRFLYSEQEADGSWYGRWGSNYLYGTWLALCALRSAGEDLTSPAVQRAVEWLLSVQQEDGGWGE

SEQ ID NO: 271 - protein, 295 aa, Unknown
  Uncultured organism
  Misc_feature (15)..(15): Xaa is any naturally occurring amino acid
  Misc_feature (30)..(30): Xaa is any naturally occurring amino acid
SPVWDTAISVISLAXSGMERGHPALVRAAXWLMSKEIKTAGDWKVTNPAGPVGGWAFEFNNAFYPDIDDSAMVMMALRHVHLDEHTAHRREKACLRGLNWLLSMQSRTGGWAAFDKDNTKVIMTKIPFADHNAMIDPPWADITGRVLEFLGYIGYDQSYPAVARAARFLREEQEEDGSWFGRWGVNYIYGTWQVLRGLAAIDEDMSQPYIRRAAEWLRSVQPPDGGWGETCATYHDPSLKGKGPATPAQTAWAVMGLMAAGIYDESVSRGIDYLVRTQRPDGTWDETEYTGTGFP

SEQ ID NO: 272 - protein, 231 aa, Unknown
  Uncultured organism
SPVWDTGLVALALQEVDKHNSQDALQRNLKQAYSWLLSKQLKDEPGDWRISKPTLTGGGWAFQFNNPHYPDVDDTAVVAFALAQAEHTELDESIHLATRWIEGMQSQNGGYGAFDVDNTFYYLNEIPFADHGALLDPPTADVSARCAMLMARVAKDHEEYLPALERTIQYLRSEQEADGSWFGRWGTNYVYGTWSVLLGLEQTNVPKTDPLFTKAAQWLKSVQRPDGGWGE

SEQ ID NO: 273 - protein, 231 aa, Unknown
  Uncultured organism
SPVWDTGLVALALPEVDKHNSQDALQPNLKQAYSWLLSKQLKDQPGDWRISKPTLTGGGWAFQFNNPHYPDVHDTAVLAFALAQAEHTELDESIHLATRWIEGMQSQNGGYGAFDVDNTFYYLNEIPFADHGALLDPPTADVSARCAMLMARVAKGHEEYLPALERTIQYLRSEQEADGSWFGRWGTNYVYGTWSVLLGLEQTNVPKTDPLFTKAAQWLKSVQRPDGGWGE

SEQ ID NO: 274 - protein, 232 aa, Unknown
  Uncultured organism
SPVWDTILSMQALLDTKEVFQPSPTLKKAMEWLLEQQVRAWGDWKVYVSDARGGGWAFQRANSFYPDVDDTIMVMMALRNVSPRGESKVVDEAIERALFWVLGMQCEDGGWAAFDRDNAKAFLTKVPFADHNAMIDPSTADLTSRTFEMFAMIAPEVFTIHHPVVRRGLEFLKKDQCKDGSWFGRWGVNYMYGTWQVLRGLRLIGEDMSKGYVRKGVEWFKSVQLEDGGWGE

SEQ ID NO: 275 - protein, 228 aa, Unknown
  Uncultured organism
SPVWDTLLALLALQDCDRELTAEMSRALDWVLANEVRYHGDWTKKVKGVEPSGWAFERANLNYPDIDDTAVALIVLARLPRAWLDEPRIRATIDRVLGWTLAMQSSNGGWAAFDKDNDRPIITKIPFCDFGEALDPPSADVTAHVLEALGLLGFDRRHPAVERGLRFLRSEQEADGSWFGRWGVNYVYGTAAVLPGLAAIGEDMTQDYIRRANDWLIAHQNPDGGWGE

SEQ ID NO: 276 - protein, 204 aa, Unknown
  Uncultured organism
  Misc_feature (201)..(201): Xaa is any naturally occurring amino acid
SPVWDTLLTLLAMEDCDRGLTPSMQRALEWVLAQEVRYAGDWSKKVKGVEPSGWAFERANLNYPDIDDTAVALIVLARLPRAWLDEPRIRATIDRVLGWTLAMQSSNGGWAAFDKDNDRPIITKIPFCDFGEALDPPSADVTAHVLEALGLPGFDRRHPAVERGYKFLRSEQEADGSWFGRWGVNHIYGTAAVLPALASIXEDM

SEQ ID NO: 277 - protein, 228 aa, Unknown
  Uncultured organism
SPVWDTLLALLAMQDCERELTPQMERALDWVLANEVRYYGDWSKKVRGVEPSGWAFERANLNYPDIDDTVVALIVLARLPRALLDQPRIRAVIDRALGWTLAMQSSNGGWAAFDKDNDHLIITKIPFCGFGEALDPPSADVTAHVLEALGLLGFDRHHPAVARGYQFLRKEQEADGSWFGRWGVNHIYGTAAVLPALAAIGEDMSQPYIRAAAEWIIAHQNADGGWGE

SEQ ID NO: 278 - protein, 204 aa, Unknown
  Uncultured organism
  Misc_feature (198)..(198): Xaa is any naturally occurring amino acid
SPVWDTLLSLLAMQDCERGFTPSMERALDWVLANEVRYYGDWSKKVRGVEPSGWAFERANLNYPDIDDTAVALIVLARLPRAQLDQPRIREVIDRALGWTLAMQSSNGGWAAFDKDNDHLIITKIPFCDFGEALDPPSADVAAHVLEALGLLGFERKHPAVERGLKFIRSEQEADGSWFGRWGVNHIYGTAAVLPALXAIGEDM

SEQ ID NO: 279 - protein, 228 aa, Unknown
  Uncultured organism
  Misc_feature (9)..(9): Xaa is any naturally occurring amino acid
  Misc_feature (31)..(32): Xaa is any naturally occurring amino acid
  Misc_feature (57)..(57): Xaa is any naturally occurring amino acid
  Misc_feature (102)..(102): Xaa is any naturally occurring amino acid
  Misc_feature (131)..(131): Xaa is any naturally occurring amino acid
  Misc_feature (191)..(191): Xaa is any naturally occurring amino acid
SPVWDTLLXLLAMQDCERESTPSMERALDWXXANEVRYYGDWSKKVRGVEPSGWAFXRANLNYPDIDDTDVALIVLARLPRALLDQSRVHAVIDRALGWTLXMQSSNGGWAAFDKDNNHLIITKIPFCDFXEALDPPSADVTAHVLEALGLLGFNRNHPAVERGYRFLRSEQETDGSWFGRWGVNHVYGTXAVLPALAAIGEDMTQPYIRSAAEWIIAHQNADGGWGE

SEQ ID NO: 280 - protein, 228 aa, Unknown
  Uncultured organism
SPVWDTLLSLVALQDCGKELTPARERALEWILGREIRTRGDWAKKVKNVEASGWAFERANLHYPDIDDTAVALIMLARLPRAWLDQPRIRAVIDRALGWTLAMQSSSGGWAAFDKDNDRLIITKIPFCDFGEALDPPSADVTAHVLEALGILGFDRQHAAVRHGLKFLRSEQEADGSWFGRWGVNHVYGTGAVLPALAAIGEDMAQDYVRRAADWLVAHQNADGGWGE

SEQ ID NO: 281 - protein, 228 aa, Unknown
  Uncultured organism
SPVWDTLLTLLAYQDCELEMNDSAGRALDWILSQENSYRGDWAHRNKKLEPSGWAFERANLHYPDIDDTSVALIVLARLPQAVRSRPDIKSAIDRALAWTLGMQCRNGGWAAFDRDNDKLIITMIPFCDFSEALDPPSADVTAHVVEAMAHLGFDRSHKAVEKAYQYLLAEQEDDGSWFGRWGVNHIYGTAAVLPALAALGEDATVPHVKRAADWISAHQNTDGGWGE

SEQ ID NO: 282 - protein, 228 aa, Unknown
  Uncultured organism
SPMWDTSLAAHALMEADGRGDPKDNPRLISAMDWLADKQILDHVGDWAVRRPDVRPGGWAFQYENPDYPDVDDTAVVVMAMHRADPERYEMSIDRACEWLVGMQSKNGGWGAFEPENEHYYLNSIPFADHGALLDPPTVDVTARCVGALAQVDRDRYAAEIANGIRSIRREQEDDGSWFGRWGANYVYGTWSALVALKGAGEDMQQPYIRRAVDWLKARQRSDGGWGE

SEQ ID NO: 283 - protein, 228 aa, Unknown
  Uncultured organism
SPVWDTCLTSNALVESGGDTSAPHVHRSVQWLLNQEIRNHGDWSVKAPKVGPSGWAFEFANKVYPDVDDAAEVIIALANYSNDSGTAPPDAIARGVRWISGMQSSNGGWGSFDKNNTSFFVTRLPFFDFGEVIDPPSVDVTAHVIEALAVAGWQEKASKQIQKALDYIWSEQEADGPWFGRWGINYIYGTCAVLSALEAIGYDMADARVVKALKWIEECQNADGGWGE

SEQ ID NO: 284 - protein, 228 aa, Unknown
  Uncultured organism
SPVWDTVAQLHALIASGLARRDEALRRAASWLLTRQSRTHGDWSGRNPAEPGGFYFEFRNEFYPDVDDTAMALMVLTQAEANVATDVQHAAIARALAWMLGMQNRDGGWAAFDRDNDKHFLTQVPFADHNAMIDPSTADITGRVLGALSHVPSYGPDHPSVRRAIAFLQRDQEPDGSWYGRWGVNYLYGTGQVLRGLRAIGFDMQQPFVRRAARFLSAHQNDDGGWGE

SEQ ID NO: 285 - protein, 227 aa, Unknown
  Uncultured organism
SPVWDTAITIIALAESGLPKNHPAFEQAATWLEKKEIRFKGDWAVRMPGVEPSGWAFEHENKYYPDTDDTMMVLMALRHVQSRNSAERCEQFDRALKWLLAFQCQDGGWAAFDKDVTASWLEHVPFADHNAILDPTCSDLTARVLELLGSISFDRQSAIVRRAVAMMRRTQETDGSWYGRWGVNYIYGTWQALRGLAAIGENMDQEWIRRGRDWLESCQNDDGGWGE

SEQ ID NO: 286 - protein, 227 aa, Unknown
  Uncultured organism
SPVWDTAINVISLAESGLLSDHPALQKAADWLVNKEVRFRGDWSVNNSYPQVSGWAFEYNNVYYPDTDDTAMVLMALRLIRPKDPQALNELFRRALDWQLSFQCRDGGWAAFDKNVTTPWLEDMPFADHNAILDPTCSDLTARTLELLGYTGFDPKAQSVRDALQYLIDTQDEDGSWYGRWGVNYIYGTWQVLRGLRAMGQDMTQDWILRGRDWLESCQNSDGGWGE

SEQ ID NO: 287 - protein, 227 aa, Unknown
  Uncultured organism
SPVWDTAITSVALTSSGVKPDHPQIQKAADWLLDREVVMRGDWKVKNPYPHASGWAFEFNNDFYPDADDTFKVLLALMKMKSSDPERQRKIMDRALDWARSFQCKDGGFAAFDKDVTKKWLEHVPFADHNAILDPSCSDITARGLECMGKLGWPRTDRVIRRAIRYLKKTQEEDGSWWGRWGVNYIYGTWQSLRGLEAIGEDMNQDWVVRARNWLESCQNPDGGWGE

SEQ ID NO: 288 - protein, 227 aa, Unknown
  Uncultured organism
SPVWDTAITAVSLAESGLEPDHPALQKSAEWLLDKEVRIQGDWAIKNRHGEASGWAFEFNNEFYPDVDDTLKVLLALRLIKTRDEETKREAMERALGWVMSFQCSDGGWAAFDKDVTQRWLEDVPFADHNAILDPTCSDITARCLELLGKMGCTSDHPAVRRALRMVRETQEPDGTWWGRWGVNYIYGTWQILRGLSALKIDMNQDWIVRAKEWLESCQNPDGGWGE

SEQ ID NO: 289 - protein, 227 aa, Unknown
  Uncultured organism
SPIWDTAIVTMAIAESGQDPNDPRLQKAADWLLEREIGFRGDWRENCDFPEATGWAFEFNNDWYPDVDDTFQVILGLKPLSASDSRRQEQTLDRAIRWCRAMQCREGGFAAFDKDINDAWLNEVPFADHNAILDPPCSDITGRALETLSLMGFDREDPVVRRARQYLMETQLEDGSWFGRWGVNYIYGTGHALRGLHAIGEDINGSAMQRARNWLENCQNDDGGWGE

SEQ ID NO: 290 - protein, 231 aa, Unknown
  Uncultured organism
SPIWDTAKAVNALHESGLPSDHPQLKAAARWLVEKEVRKPGDWKMRVPHVDVGGWPFQFRNEFYPDVDDTAAVVMALGRVDERDVPGIKDSITRGINWVTQMQCSCGGWAAFDVDVKREFLTKVPYADHNAMLDPPCPDITGRCLEMYGRFPGVRKDADVQRVIEKGIEYLKKTQEPDGSWYGRWGVNYIYGTWQSLKGLAAVGEDPSQPYIQKAAHFLKTHQNSDGGWGE

SEQ ID NO: 291 - protein, 231 aa, Unknown
  Uncultured organism
SPMWDTAKAVNALHESGLPSDHPQLKAAARWLVEKEVQKPGDWKMRVPYVDVGGWPFQFRNEFYPDVDDTAAVVMALGRVDERDVPGIKDSITRGINWVTQMQCSCGGWAAFDVDVKREFLTKVPYADHNAMLDPPCPDITGRCLEMYGRFPEVRKDVDVQRVIEKGIEYLKKTQEPDGSWYGRWGVNYIYGTWQSLKGLAAVGEDPSQPYIQKAAHFLKTHQNSDGGWGE

SEQ ID NO: 292 - protein, 231 aa, Unknown
  Uncultured organism
SPVWDTAKAVNALHESGLPSDHPQLKAAARWLVEKEVRKPGDWKMRVPHVDVGGWPFQFRNEFYPDVDDTAAVVMALGRVDERDVPGIKDSITRGINWVTQMQCSCGGWAAFDVDVKREFLTKVPYADHNAMLDPPCPDITGRCLEMYGRFPEVRKDANVQNVIAKGIEYLKKTQEPDGSWYGRWGVNYIYGTWQSLKGLAAVGEDPSQPYIQKAAHFLKTHQNSDGGWGE

SEQ ID NO: 293 - protein, 227 aa, Unknown
  Uncultured organism
SPVWDTCLSLAALTEAGAQNDHPAVKQAVEWLLDHQIFVEGDWCAQASGLEPGGWAFQYENDKYPDVDDTGMVLMSLLRAGVHDKEHKRKRVNQALNWVLGMQNPDGSWGAFDIENNYEYLNKIPFADHGALVDPGTADLTARCVELLAMLGYDATFPPVKRALEFLEHDQEEDGSWYGRWGVNYIYGTWSVLCALGAIGEDVAKPYVRKSVQWLQDTQNEDGGWGE

SEQ ID NO: 294 - protein, 227 aa, Unknown
  Uncultured organism
SPVWDTCLSLAALTEAGAQNDHPAVKQAVEWLLDHQIFVEGDWCDQAPGLEPGGWAFQYENNKYPDVDDTGMVLMSLLRAGVHDKEHKRKRVNQALNWVLGMQNPDGSWGAFDIENNYEYLNRIPFADHGALVDPGTADLTARCVELLAMLGYDATFPPVKRALEFLEQDQEEDGSWYGRWGVNYIYGTWSVLCALGATGEDVAKPYVRKSVQWLQDTQNEDGGWGE

SEQ ID NO: 295 - protein, 227 aa, Unknown
  Uncultured organism
SPVWDTCLSLTAMTESGAHPEHPAVKQAVEWLLDQQIFVKGDWADQAKNLEPGGWAFQFENDRCPDVDDTGMVLMALLRAGVQDKEHKIKRINQAVNWVLGMQNPDGSWGAFDIGNDHEYLNNIPFADHGALVDPGTADLTARCVELLAMLGYGPDFPPIQRAVAFLERDQEEFGAWYGRWGVNYIYGTWSVLSAIGILGEDYAKPYVRKAVEWLKEIQNDDGGWGE

SEQ ID NO: 296 - protein, 227 aa, Unknown
  Uncultured organism
SPVWDTCLSLNALTEADMPANDPRVRAAVQWLFDRQIFVRGDWSENAPELEPGGWAFQYENDKYPDVDDTGMVLMSLLRANAHEHDAQRKRMNQALNWVLGMQNSDGSWGAFDIDNHYTYLNNIPFADHGALVDPGTADLTGRCIELFGMLGYDKNFTPARRGIEFLKRDQHPCGGWYGRWGVNYLYGTWSVLTALGAIGEARDAPYLRRAVEWLYSVQNDDGGWGE

SEQ ID NO: 297 - protein, 227 aa, Unknown
  Uncultured organism
SPVWDTALVLQAMQEASIPLDHPALVKAAQWLLDREVRIKGDWKIKSPGLEPGGWAFEFQNDWYPDVDDSAAVLIAIKDIQVKNNKAKQGAVRRGIDWCLGMQSKNGGWGAFDKDNTKHLLNKIPFADLEALIDPPTADLTGRMLELMGNFGYDKHHPQAVHALEFLKKEQEPEGPWFGRWGVNYIYGTWYVLIGLEAIGEDMNQPYIKKAANWIKSRQNIDGGWGE

SEQ ID NO: 298 - protein, 227 aa, Unknown
  Uncultured organism
  Misc_feature (78)..(78): Xaa is any naturally occurring amino acid
SPVWDTTLVLVAMQEAGVPVDHPALVKSAQWLLDLEVRRKGDWQVKSPDVEPGGWAFEFMNDWYPDVDDSGFVMLAIXNIRVRDKKHQEQAIKRGIAWCLEMQSENGGWGAFDKDNTKYLLNKIPFADLEALIDPPTADLTGRMLELMGNFDYSASYPAAVRALEFLKKEQEPEGPWWGRWGVNYIYGTWSVLCGLEAIGEDMSQPYIRKAVNWLKSKQNLDGGWGE

SEQ ID NO: 299 - protein, 294 aa, Unknown
  Uncultured organism
SPVWDTALVLVAMQEAGVPVDHPALIKSAQWLLDLEVRRKGDWHVKSPDLEPGGWAFESLNDWYPDVDDSGFVMLFIKDIKVRDKKLKDQAIKCGIAWCLGMQSENGGWGAFDKDNTKHLLNKIPFADLEALIDPPTADLTGRMLELMGNFNYPKSHQAAVKALDFLKVEQEPEGPWWGRWGVNYIYGTWSVLCGLEAIGEDMSQPYIKKAVNWLKSKQNLDGGWGEVCDSYADRSLMGCGPSTASQTSWALLSLFAAGEVSSKAALRGVEYLLSTQKLDGTWDEDAFTGTGFP

SEQ ID NO: 300 - protein, 294 aa, Unknown
  Uncultured organism
  Misc_feature (15)..(15): Xaa is any naturally occurring amino acid
  Misc_feature (21)..(21): Xaa is any naturally occurring amino acid
  Misc_feature (38)..(39): Xaa is any naturally occurring amino acid
  Misc_feature (58)..(58): Xaa is any naturally occurring amino acid
  Misc_feature (79)..(79): Xaa is any naturally occurring amino acid
  Misc_feature (128)..(128): Xaa is any naturally occurring amino acid
  Misc_feature (139)..(139): Xaa is any naturally occurring amino acid
  Misc_feature (168)..(168): Xaa is any naturally occurring amino acid
  Misc_feature (171)..(171): Xaa is any naturally occurring amino acid
  Misc_feature (174)..(174): Xaa is any naturally occurring amino acid
SPVWDTALVLVAMQXAGVPVXHPALVKSAQWLLDLEVXXKGDWQVKSPELEPGGWAFXFLNDWYPDVDDSGFVMLSIKXIKVRDKKHKEQAIKRGISWCLGMQSDNGGWAAFDKNNTKYLLNKIPFAXLEALIDPPTAXLTGRMLELMGNFNYPKTHKAAVQALEFLXMEXEPXGPWWGRWGVNYIYGTWSVLCGLEAIGEDMAQPYIKKSINWLKSKQNMDGGWGEVCESYGDRSLMGCGPSTASQTSWALLSLFAAGEVHSKAATRGIEYLLATQKLDGTWDEDAYTGTGFP

SEQ ID NO: 301 - protein, 227 aa, Unknown
  Uncultured organism
SPVWDTALALVAMQEAGVPKDHPALVKAAQWLLDLEVRRKGDWQIKSPELEPGGWAFEFLNDWYPDVDDSGFVIMAIRDIKAPDKKHKEQAIKRGIAWCLGMQSKNGGWGAFDKDNTKHLLNKIPFADLEALIDPPTADLTGRMLELMGSFDYPMDHPAAARALEFLKKEQEPEGPWWGRWGVNYIYGTWSVLCGLESIGEDMSQPYIKKAVNWLKSKQNMDGGWGE

SEQ ID NO: 302 - protein, 294 aa, Unknown
  Uncultured organism
SPVWDTSLVLVAMQEAGVPVDHPALVKAAQWLLDREVRLKGDWRVKSPDLEPGGWAFEFLNDWYPDVDDSGFVMLALKDIKVRDKKQKSQAIKRGIAWCLGMQSANGGWGAFDKDNTKYLLNKIPFADLEALIDPPTADLTGRMLELMGTFNYPKSHVAVVRALGFLKSVQEPEGPWWGRWGVNYIYGTWSVLGGLDAIGEDMSQPYIRKAVNWLKSKQNLDGGWGEVCETYEDRSLMGCGPSTPSQTSWALLSLFSAGEINAKAVLRGIKYLVETQNQDGSWDEDAYTGTGFP

SEQ ID NO: 303 - protein, 227 aa, Unknown
  Uncultured organism
SPVWDTALVLVAMQEAGVPLDHPALVKAAQWLLDREVRIKGDWRIKSPDIEPGGWAFEFLNDWYPDVDDSGFVMLAIKDVKVRDKKKKEQAIKRGINWCLGMQSANGGWGAFDKDNTKYLLNKIPFADLEALIDPPTADLTGRMLELLGTFNFPKDHHAIERALEFIQLEQEPEGPWWGRWGVNYIYGTWSVISGLEAIGEDMSQPYIRKTVNWLKSKQNMDGGWGE

SEQ ID NO: 304 - protein, 294 aa, Unknown
  Uncultured organism
  Misc_feature (22)..(22): Xaa is any naturally occurring amino acid
SPVWDTPWMVMALLEAGVPTDXPGLLRAGRWLISKQITGVHGDWAVKNRHALPGGWSFEFENDYFPDVDDTIEVLHVIHRLAIPWEEKSECCRLGLDWLLSMQNDDGGWGAFDRNQTLVMVNRIPFSDHAACLDPSSPDIVGRVLEFLASRSFSREHPAVKRALDYIWREQSPFGGWWARWGIDYLYGTWCVLTGLRAIGWDMEDPRVRKAVAWLESVARPDGGYGESPESYRDHSYVEWKRSVPSQTAWALMGLVAGGVGHGKAARGAADYLLTSRNAQGGWDEMDYTGTGFP

SEQ ID NO: 305 - protein, 294 aa, Unknown
  Uncultured organism
  Misc_feature (24)..(24): Xaa is any naturally occurring amino acid
  Misc_feature (36)..(36): Xaa is any naturally occurring amino acid
  Misc_feature (99)..(99): Xaa is any naturally occurring amino acid
  Misc_feature (103)..(103): Xaa is any naturally occurring amino acid
  Misc_feature (117)..(117): Xaa is any naturally occurring amino acid
  Misc_feature (151)..(151): Xaa is any naturally occurring amino acid
  Misc_feature (173)..(173): Xaa is any naturally occurring amino acid
  Misc_feature (202)..(202): Xaa is any naturally occurring amino acid
SPVWDTPWMVMALLEAGCPANDPXLIRAGRWLKAKXITEVRGDWAVKNRKALPGGWSFEFENDYFPDVDDTIEVLSVIHRLSIPWNEKAKSCRLGLEWXLSMXNRDGGWGAFDREQXFKVVNRIPFSDHAACLDPSSPDITGRMVEFLASXNFSKGHVAVRRALDYIWKQQAXFGGWWARWGIDYLYGTWCVLTGLASLGFXMDDPRARKAADWLESIQHADGGFGESPESYREDSFVDWKRSVPSQTAWALMGLVAAGRASGAAAQRAAAWLLDNRNTNGSWDEQDYTGTGFP

SEQ ID NO: 306 - protein, 294 aa, Unknown
  Uncultured organism
SPVWDTPWTVMALLEAGVPSNDPALLRSGRWLLAKQITDTKGDWAIKNKNTAPGGWSFEFENKYFPDVDDTIEVLHCLHKLAIPWREKEKPCRLGIDWLLSMQNDDGGWGAFDKNQKRQVVNRIPFSDHGACLDPSSPDITGRMIEFLATQKFNSEYESVKRALKYIWKTQEDFGGWHARWGINYIYGTWCVLTGLRAIGFNMTDRRVQKALNWLESIQNKDGGFGESPASYEECRYIPWKESVPSQTAWALMALVAGGGAGSAPAENAATFLINYRNSNGVWDEECYTGTGFP

SEQ ID NO: 307 - protein, 295 aa, Unknown
  Uncultured organism
SPVWDTPWMIEALLETGVPPGDPALLRAGRWLMSKQITGVRGDWAMKSPKGKPGGWAFEFENDYYPDVDDTIQVLTALCKLSIPWREKEKAVMQGIDWLISMQNDDGGWGAFDRNQTRWIVNRIPFSDHKACLDPSSPDITGRMVEFLMRRNYSTSHPSVKKALKYIRETQEDFGAWFARWGINYIYGTWCVLTALAAMGIGHTDSRVAKAVAWLSSVQRPDGGFSEAADTYHPHKPFESYSESVPSQSAWALMGLVAGGAVHSPAAARAACYLINNRNLNNGWDERHYTGTGFP

SEQ ID NO: 308 - protein, 226 aa, Unknown
  Uncultured organism
SPVWDTAIAGYALGESGCAPQSALRRMADWLLTKEVRRKDDWSVKRPDVEPSGWYFEFANEFYPDTDDTAMVLLSLLHGRATNPAAQEACAKRAVNWLLAMQSKDGGWAAFDVDNDWKPLSYVPFADHNAMLDPSCPDITGRVLEALCKYGVSQEHPAVLRAIDYLIQTQEQDGSWHGRWGVNYVYGTFLALRGLKAAGVSDREAYVLRAGEWLDLIQNPDGGWGE

SEQ ID NO: 309 - protein, 226 aa, Unknown
  Uncultured organism
SPVWDTVLSITALADADLPRTHPAMRRAVAWVLGKQVLCEGDWRVKNRRGEPGGWSFEFNNNFYQDNDDTAAVLIALHKARLPDEAKGEAMQRGLRWLLSMQCDDGGWSAFDVNNNKRLLNKIPFADLESMLDPSTCDLTGRTLEALGSIGFPFTHRIVQHAVRFIRQHQEADGAWYGRWGVNYIYGTCHVLCGLLSVGEDMHQPYVQRAVQWLIEHQNADGGWGE

SEQ ID NO: 310 - protein, 226 aa, Unknown
  Uncultured organism
SPVWDTALAVRALAAAGLPPEHPAMVKASEWLLTQQIFKPGDWSVKCPDLPPGGWAFEFVNNWYPDVDDSSMVLVALKEGLADAAKHQAALQRGINWCLGMQSKNGGFASFDKDNTKEWLNAIPFGDLKALVDPPTEDITARILEMMGAFGHGLDHPVAVRGLAYLHQTQRPEGPWWGRWGVNYIYGTWSVLVALKRIGEDMSRPYVRRAVDWVKAHQNPDGGWGE

SEQ ID NO: 311 - protein, 226 aa, Unknown
  Uncultured organism
SPVWDTALAVRALAAAGLPPEHPAMVKASEWLLTQQIFKPGDWSVKCPDLPPGGWAFEFVNNWYPDVDDSSMVLVALKDGLVDAAKHQAALQRGINWCLGMQSKNGGFASFDKDNTKEWLNAIPFGDLKALVDPPTEDITARILEMMGAFGHGLDHPVAVRALAYLHQTQRPEGPWWGRWGVNYIYGTWSVLVALKRIGEDMNRPYVRRAVDWVKAHQNLDGGWGE

SEQ ID NO: 312 - protein, 293 aa, Unknown
  Uncultured organism
SPVWDTALAVRALAAAGVPPEHPAMVQASEWLLTQQIFKPGDWSVKCPDLPPGGWAFEFVNNWYPDVDDSSMVLVALKDGLADAAKHQAALQRGINWCLGMQSKNGGFASFDKDNTKEWLNAIPFGDLKALVDPPTEDITARILEMMGAFGHGLDHPVAVRAMAYLHETQRPEGPWWGRWGVNYIYGTWSVLVALKRIGEDMSRPYVRRAVDWVKAHQNLDGGWGECCESYRNPELMGRGPSTASQTAWALLGLFASGEVHTPEVKAGVDYLVKTQNSLGRWDEEQFTGTGFP

SEQ ID NO: 313 - protein, 226 aa, Unknown
  Uncultured organism
SPIWDTALAVRALTAAGMPPEHPAMVKASEWLLTQQIFKPGDWSVKCPDLPPGGWAFEFVNNWYPDVDDSSMVLVALKEGLADTAKHQAALQRGINWCLGMQSKNGGFASFDKDNTKEWLNAIPFGDLKALVDPPTEDITARILEMMGAFGHGLDHPVAVRALAYLHETQRPGGPWWGRWGVNYLYGTWSVLVALKRIGEDMSRPYVRRAVDWVKDHQNLDGGWGE

SEQ ID NO: 314 - protein, 293 aa, Unknown
  Uncultured organism
SPVWDTALAVRALAAAGVPPEHPAMVKASEWLLTQQIFKPGDWSIKCPDLPPGGWAFEFVNNWYPDVDDSSMVLVALKDGLADAAKHQAALQRGINWCLGMQSKNGGFASFDKDNTKEWLNSLPFGDLKALVDPPTEDITARILEMMGAFGHGLDHPVAARALAYLHQTQRPEGPWWGRWGVNYIYGTWSVLVALKRIGEDMSRPYVRRAVDWVKAHQNPDGGWGEFCESYRNPELMGKGPSTASQTAWALLGLFAAGEVHAPEVTAGVDYLVKTQDSLGRWDEEQFTGTGFP

SEQ ID NO: 315 - protein, 293 aa, Unknown
  Uncultured organism
  Misc_feature (58)..(58): Xaa is any naturally occurring amino acid
  Misc_feature (200)..(200): Xaa is any naturally occurring amino acid
SPVWDTALAVRALAAAGLPPDHPFMTQATSWLLTQQIFKPGDWCIKCPDLPPGGWAFXFHNNWYPDVDDSSMVLVALKDGLPDTARHQAALQRGINWCLGMQSKNGGFASFDKDNTKEWLNALPFGDLKALVDPPTEDITARILEMMGAFGHGLDHPTADRALAFLRRTQHPEGPWWGRWGVNYLYGTWSVLVALKRIGXDMSRPYVQRAVNWIKSHQNPDGGWGEVCESYRHPELMGQGPSTASQTAWALLGLLAAGEIQAAEVKAGVDYLVKTQNAQGRWDEKYFTGNWLP

SEQ ID NO: 316 - protein, 231 aa, Unknown
  Uncultured organism
SPVWDTAWAVIGLCESGMERTHPAVRSAIRWLYSMQILRPGDWAVKNPLTEPGGWAFEFHNDFYPDNDDTAAVLMGLLFSDLNDEENHRAFERGVRWLLSMQNNDSGWGAFERNVDNKIFDQIPFNDQKNMLDPSTADVTGRVVELLGRIGRRLGGSFSDEPYVRQAIEFLKNEQEPEGCWFGRWGVNYIYGTWSVLVALEAIGESMRAPYIRKAVNWVKKVQNPDGGWGE

SEQ ID NO: 317 - protein, 226 aa, Unknown
  Uncultured organism
  Misc_feature (105)..(105): Xaa is any naturally occurring amino acid
  Misc_feature (202)..(202): Xaa is any naturally occurring amino acid
SPVWDTILGMIGLVDCGHDGKDPLLVTARDWIVKRQLLVNYGDWKVYNPNGPSGGWSFEYDNSWYPDVDDTAAIVIGFLKQDYEFRHSEVVKRACDWIASMQNQXGGWAAFDINNDKTFLNEIPFSDMESLCDPSSPDVVGRVLEAFGILNDPKYAEVCRRGIEYLRRTQESEGSWFGRWGVNYVYGTSNVLCSLKRQDVAXKDPMVTRALTWLKKVQNKDGGWGE

SEQ ID NO: 318 - protein, 225 aa, Unknown
  Uncultured organism
SPVWDTGLALHALLESGMDPDDPAIAKAMHWLDEREITDVAGDWAEQRPGLAPGGWAFQYRNDHYPDVDDTAVVGMAMHRANPQARPETLERTRAWIEGMQSQNGGWGAFDADNTHYHLNHIPFADHGAMLDPPTADVSARCLGMLSQMGYDRDHPSIQRAIAYLKNDQEEDGSWFGRWGTNYIYGTWSVLSALNAAGEDMSQPYIRKAVDYLTNFQREDGGWGE

SEQ ID NO: 319 - protein, 225 aa, Unknown
  Uncultured organism
SPVWDTSLSAHALMEAGLEENDKRLEGLLDWLKDLQILDVKGDWVARRPDVRPGGWAFQYRNDHYPDVDDTAVVAMAMHRQGDEKYKEAIDRAAEWIVGMQSSSGGWGAFDPENEHFYLNSIPFADHGALLDPPTEDVTARCVGFLAQLDPDAYAEPIKRGVEFLKRTQQEDGSWWGRWGANFVYGTWSVLCALNAAGEDPKSPYIQKAVAWLKSRQREDGGWGE

SEQ ID NO: 320 - protein, 225 aa, Unknown
  Uncultured organism
  Misc_feature (163)..(163): Xaa is any naturally occurring amino acid
SPVWDTCLGLHALLEAGEPREAPSVKKAVDWLLEREITETYGDWVWRRPHLKPSGWAFQYWNNYYPDVDDTAVVVMALDRVGDPRCRPAIERACEWIIGMQSTSGGWGSFDPENEFTYLNHIPFADHGALLDPPTVDVTARCISMLAQVGYRHDHPAIRKSVXFILREQEKDGSWYGRWGTNYVYGTWSALSALNAVGEDMSSPVVRKGVAWLEAFQQPDGGWGE

SEQ ID NO: 321 - protein, 225 aa, Unknown
  Uncultured organism
  Misc_feature (129)..(129): Xaa is any naturally occurring amino acid
  Misc_feature (136)..(136): Xaa is any naturally occurring amino acid
  Misc_feature (193)..(193): Xaa is any naturally occurring amino acid
  Misc_feature (208)..(208): Xaa is any naturally occurring amino acid
  Misc_feature (215)..(215): Xaa is any naturally occurring amino acid
SPVWDTGIACQALQEVGGPAADAGVQRALDWLVERQLRDEPGDWRRDRPDLEGGGWAFQYNNPHYPDLDDTSMVAWVMQVADHGRYREEIRRAAKWVVGMRSEGGGFASFEVDNTYYYLNHIPFADHGXLLDPPTXDVTARCIAVLAITDRAQHETVIREAIDFLFVDQEEDGSWFGRWGTDYIYGTWSVLSXLDVVGFDMRDARVRXSVEWLFXQQNPDGGWGE

SEQ ID NO: 322 - protein, 224 aa, Unknown
  Uncultured organism
SPVWDTGIAAHALGEAGHASAMQSTADWLLTKEVRRKGDWSVKRPDVEPSGWYFEFANEFYPDIDDTAQVLLGLAHAKASDPAKQKACMDRAVAWLLAMQGSDGGWAAFDVDNNWEFLSSVPFADHNAMLDPTCPDITGRVLEALAACGVPNSHPAVKRGVEFLRNSVEKDGSWYGRWGVNYIYGTYLALRGLRASGEDDREAHILRAGEWLRAIQNADGGWGE

SEQ ID NO: 323 - protein, 224 aa, Unknown
  Uncultured organism
SPMWDTSLAAHAFLESGDREDPRLIRALDWLVDKQILDHVGDWAVRRPGLRPGGWAFQYENPDYPDVDDTAVVAMAMHRTDPERYAENIDRACEWLAGMQSKNGGWGAFDPENEHYYLNSIPFADHGALLDPPTVDVTARCIGCLAQVDAEAFADNIKRGIGFIKREQEPDGSWFGRWGANYIYGTWSALVALKGAGEDMSQPYIRKSVAWLKGRQGPDGGWGE

SEQ ID NO: 324 - protein, 224 aa, Unknown
  Uncultured organism
SPVWDTSLAAHALLEAGEPNDPEVIGLLDWLKDKQILTTVGDWSARRPNLRPGGWAFQYENPHYPDVDDTAVVAMAMHRQGDPKYAEAIARACEWLAGMQSSSGGWGAFDPENEHFYLNSIPFADHGALLDPPTVDVTARCVGCLAQVDAERFASEIQAGIDYIKREQEEDGSWFGRWGANYVYGTWSALVALNKAGEDMNTPYIRRAVDWLKARQRPDGGWGE

SEQ ID NO: 325 - protein, 640 aa, Verrucomicrobium spinosum
MATSDPSLAEAIQNTRAHLLSLRNARGHWEGHLSNSALSTATAIVALHLVDAPLHSARIAQGVRWLVLHQNKDGGWGDTTLSKSNLSTTLLCWSALSLCEPDRTEPIQHCEAWIKERTGSLEPEVICRAVVARYGKDKTFSVPILMLCAIGGRLGPEKEAWSRVLALPFELAAMPREWFGAIGLPVVSYALPALIAIGYARFYHAPPSLLNPLHALRKALWPRISPMLKLLQPSTGGYLEATPLTSFVTMALASAGEKFHPCVPEAVRFLEDSQRPDGSWPIDTNLATWGTTLSTKALTATSEGREALDIPALKSWLLEQQYQEIHPFTNAAPGGWAWTDLPGGVPDADDTSGALVALWHLCEDEAERQALAPAVAKGVQWLMDLQNRDGGIPTFCRGWGTLPFDRSTPEITAHALHAWGLWQVVLPEELQQEVSLRIPRAIAFIARPPSRGAPGFNHVPLWFGNEHAKEEENHVYGTAQIMNHLLSSGLNTPEIKVILETGHRNLLAWQQLDGGWSGSETGPASLEETAVSVAALALHTLHAGNRTRSSAEDAVAKGTQWLVQHTATGTTFPSAPIGLYFARLWYHEQLYPVIWTLGALHAVETLSAAALPLRARASAPPQHPGVVRTKPIHIAPPSDP

SEQ ID NO: 326 - protein, 649 aa, Acidiphilium cryptum
MFDTISFDFDALDQAISRAHARLSAEQRADGHYVYELEADATIPAEYVLLEHFLDRIDPELEARIGVFLRGIQGNSPQNPGGWPLFHDGAMDISASVKAYFALKAIGDDPDAPHMRRAREAILARGGAARTNVFTRIQLALFGAVPWRACPVMPVEIMLLPDWFPITIWKISYWSRTVIAPLLVLLTERPIARNPRNVRIDELFVTPPDQVTDYIRGPYRSNWGYLFKAIDSALRPLERHFPARSRKRAIQAAIDFITPRLNGEDGLGAIYPAMANTVMMYHTLGYSPDHPDYATAWASVRKLVTDASYRFEGASYVQPCLSPVWDTSLAAHALAEAGSPGDAQLAAACDWLIPRQILDVKGDWAYRKPDAPPGGWAFQYNNAHYPDVDDTAVVGMILDRNGDPAHREAVERARQWILGMQSRSGGWGAFDSDNEFHYLNHIPFADHGALLDPPTADVTARCISFLAQLGHAEDRPAIERGVAYLRREQEQDGSWFGRWGTNYIYGTWSSLCALNAAGVAQDDPMMVRAVEWLLARQRPDGGWGEDCETYAHAKPGEYHESLPSQTAWALLGLMAAGQAEHEAVARGIAWLQSVQEDDGSWTEQPYNAVGFPRVFYLRYHGYPRFFPLLAMARYRNLARGNSRQVQFGF

SEQ ID NO: 327 - DNA, 25 bp, Unknown
  PCR Primer
gcgctgtttcatatgggtattgaca

SEQ ID NO: 328 - DNA, 25 bp, Unknown
  PCR Primer
gcgcttaccctggatcctcgaaaat

SEQ ID NO: 329 - DNA, 31 bp, Artificial Sequence
  PCR Primer
gttattatccttatcgatggctccccaaccg

SEQ ID NO: 330 - DNA, 32 bp, Artificial Sequence
  PCR Primer
ggttggggagccatcgataaggataataacag

SEQ ID NO: 331 - DNA, 31 bp, Artificial Sequence
  PCR Primer
gttattatccttatccatggctccccaaccg

SEQ ID NO: 332 - DNA, 32 bp, Artificial Sequence
  PCR Primer
ggttggggagccatggataaggataataacag

SEQ ID NO: 333 - DNA, 31 bp, Artificial Sequence
  PCR Primer
gttattatccttatcggtggctccccaaccg

SEQ ID NO: 334 - DNA, 32 bp, Artificial Sequence
  PCR Primer
ggttggggagccaccgataaggataataacag

SEQ ID NO: 335 - DNA, 31 bp, Artificial Sequence
  PCR Primer
gttattatccttatcctgggctccccaaccg

SEQ ID NO: 336 - DNA, 32 bp, Artificial Sequence
  PCR Primer
ggttggggagcccaggataaggataataacag

SEQ ID NO: 337 - DNA, 31 bp, Artificial Sequence
  PCR Primer
gttattatccttatcgttggctccccaaccg

SEQ ID NO: 338 - DNA, 32 bp, Artificial Sequence
  PCR Primer
ggttggggagccaacgataaggataataacag

SEQ ID NO: 339 - DNA, 31 bp, Artificial Sequence
  PCR Primer
gttattatccttatctttggctccccaaccg

SEQ ID NO: 340 - DNA, 32 bp, Artificial Sequence
  PCR Primer
ggttggggagccaaagataaggataataacag

SEQ ID NO: 341 - DNA, 31 bp, Artificial Sequence
  PCR Primer
gttattatccttatcatcggctccccaaccg

SEQ ID NO: 342 - DNA, 32 bp, Artificial Sequence
  PCR Primer
ggttggggagccgatgataaggataataacag

SEQ ID NO: 343 - DNA, 31 bp, Artificial Sequence
  PCR Primer
gttattatccttatcttcggctccccaaccg

SEQ ID NO: 344 - DNA, 32 bp, Artificial Sequence
  PCR Primer
ggttggggagccgaagataaggataataacag

SEQ ID NO: 345 - DNA, 31 bp, Artificial Sequence
  PCR Primer
gttattatccttatcccaggctccccaaccg

SEQ ID NO: 346 - DNA, 32 bp, Artificial Sequence
  PCR Primer
ggttggggagcctgggataaggataataacag

SEQ ID NO: 347 - DNA, 31 bp, Artificial Sequence
  PCR Primer
gttattatccttatcacgggctccccaaccg

SEQ ID NO: 348 - DNA, 32 bp, Artificial Sequence
  PCR Primer
ggttggggagcccgtgataaggataataacag

SEQ ID NO: 349 - DNA, 31 bp, Artificial Sequence
  PCR Primer
gttattatccttatcgcaggctccccaaccg

SEQ ID NO: 350 - DNA, 32 bp, Artificial Sequence
  PCR Primer
ggttggggagcctgcgataaggataataacag

SEQ ID NO: 351 - DNA, 31 bp, Artificial Sequence
  PCR Primer
gttattatccttatcaccggctccccaaccg

SEQ ID NO: 352 - DNA, 32 bp, Artificial Sequence
  PCR Primer
ggttggggagccggtgataaggataataacag

SEQ ID NO: 353 - DNA, 31 bp, Artificial Sequence
  PCR Primer
gttattatccttatcgctggctccccaaccg

SEQ ID NO: 354 - DNA, 32 bp, Artificial Sequence
  PCR Primer
ggttggggagccagcgataaggataataacag

SEQ ID NO: 355 - DNA, 31 bp, Artificial Sequence
  PCR Primer
gttattatccttatccggggctccccaaccg

SEQ ID NO: 356 - DNA, 32 bp, Artificial Sequence
  PCR Primer
ggttggggagccccggataaggataataacag

SEQ ID NO: 357 - DNA, 31 bp, Artificial Sequence
  PCR Primer
gttattatccttatcatgggctccccaaccg

SEQ ID NO: 358 - DNA, 32 bp, Artificial Sequence
  PCR Primer
ggttggggagcccatgataaggataataacag

SEQ ID NO: 359 - DNA, 31 bp, Artificial Sequence
  PCR Primer
gttattatccttatccagggctccccaaccg

SEQ ID NO: 360 - DNA, 32 bp, Artificial Sequence
  PCR Primer
ggttggggagccctggataaggataataacag

SEQ ID NO: 361 - DNA, 31 bp, Artificial Sequence
  PCR Primer
gttattatccttatcaacggctccccaaccg

SEQ ID NO: 362 - DNA, 32 bp, Artificial Sequence
  PCR Primer
ggttggggagccgttgataaggataataacag

SEQ ID NO: 363 - DNA, 31 bp, Artificial Sequence
  PCR Primer
gttattatccttatccgcggctccccaaccg

SEQ ID NO: 364 - DNA, 32 bp, Artificial Sequence
  PCR Primer
ggttggggagccgcggataaggataataacag

SEQ ID NO: 365 - DNA, 31 bp, Artificial Sequence
  PCR Primer
gttattatccttatcataggctccccaaccg

SEQ ID NO: 366 - DNA, 32 bp, Artificial Sequence
  PCR Primer
ggttggggagcctatgataaggataataacag

SEQ ID NO: 367 - DNA, 30 bp, Artificial Sequence
  PCR Primer
gccgataaaaatcgcaacgcagcataaacg

SEQ ID NO: 368 - DNA, 30 bp, Artificial Sequence
  PCR Primer
cgtttatgctgcgttgcgatttttatcggc

SEQ ID NO: 369 - DNA, 30 bp, Artificial Sequence
  PCR Primer
gccgataaaaatctttacgcagcataaacg

SEQ ID NO: 370 - DNA, 30 bp, Artificial Sequence
  PCR Primer
cgtttatgctgcgtaaagatttttatcggc

SEQ ID NO: 371 - DNA, 30 bp, Artificial Sequence
  PCR Primer
gccgataaaaatccgcacgcagcataaacg

SEQ ID NO: 372 - DNA, 30 bp, Artificial Sequence
  PCR Primer
cgtttatgctgcgtgcggatttttatcggc

SEQ ID NO: 373 - DNA, 30 bp, Artificial Sequence
  PCR Primer
gccgataaaaatcgctacgcagcataaacg

SEQ ID NO: 374 - DNA, 30 bp, Artificial Sequence
  PCR Primer
cgtttatgctgcgtagcgatttttatcggc

SEQ ID NO: 375 - DNA, 32 bp, Artificial Sequence
  PCR Primer
gaaccgcaccggtgccatagatcgcattaacg

SEQ ID NO: 376 - DNA, 34 bp, Artificial Sequence
  PCR Primer
ggtttggtcgttggggcgttaatgcgatctatgg

SEQ ID NO: 377 - DNA, 31 bp, Artificial Sequence
  PCR Primer
ccataatcgggaagaattgccgcgcaaaatc

SEQ ID NO: 378 - DNA, 30 bp, Artificial Sequence
  PCR Primer
ctgcgttatgattttgcgcggcaattcttc

SEQ ID NO: 379 - DNA, 32 bp, Artificial Sequence
  PCR Primer
ggcggttggggcgcttgcgatgccaataacag

SEQ ID NO: 380 - DNA, 32 bp, Artificial Sequence
  PCR Primer
ctgttattggcatcgcaagcgccccaaccgcc

SEQ ID NO: 381 - DNA, 31 bp, Artificial Sequence
  PCR Primer
cattatctttatcgcatgcaccccaaccacc

SEQ ID NO: 382 - DNA, 31 bp, Artificial Sequence
  PCR Primer
ggtggttggggtgcatgcgataaagataatg

SEQ ID NO: 383 - DNA, 28 bp, Artificial Sequence
  PCR Primer
cggctggggcgcgtgcgataaagataac

SEQ ID NO: 384 - DNA, 28 bp, Artificial Sequence
  PCR Primer
gttatctttatcgcacgcgccccagccg

SEQ ID NO: 385 - DNA, 31 bp, Artificial Sequence
  PCR Primer
cggcgcctggggcgcctgcgacgtcgacaac

SEQ ID NO: 386 - DNA, 31 bp, Artificial Sequence
  PCR Primer
gttgtcgacgtcgcaggcgccccaggcgccg

SEQ ID NO: 387 - DNA, 24 bp, Artificial Sequence
  PCR Primer
tatgcatatgggtattgacagaat

SEQ ID NO: 388 - DNA, 27 bp, Artificial Sequence
  PCR Primer
ccggatcctcaattattcaaatcaatc

The invention claimed is:

1. A method of production of isopulegol of general formula (I)

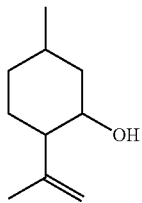

(I)

comprising cyclizing citronellal of general formula (II)

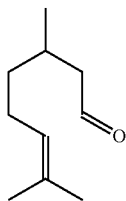

(II)

to isopulegol of formula (I) by means of an enzyme mutant with cyclase activity which is a mutant of a wild-type enzyme comprising the amino acid sequence of SEQ ID NO: 2 with a mutation at a position corresponding to position F486 of the amino acid sequence of SEQ ID NO: 2, wherein up to 10% of the amino acid residues in said enzyme mutant are altered relative to SEQ ID NO: 2 by deletion, insertion, substitution, addition, inversion, or a combination thereof, and
wherein said enzyme mutant catalyzes at least the cyclization of a citronellal isomer to at least one isopulegol isomer, or in the presence of a microorganism expressing said enzyme mutant.

2. A method for enzymatic or biocatalytic conversions of compounds of general formula IV

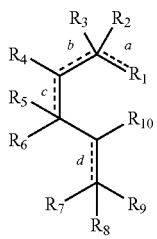

(IV)

in which
"a", "b", "c" and "d", in each case independently of one another, represent a single or double C—C bond, with the proviso that cumulative double bonds are excluded; and with the following provisos:
$R_1$ is defined as:
(1) when "a" is a double bond:
$R_1$ is selected from the group consisting of:
oxo (=O), and
CH—(CH$_2$)$_n$—Z,
in which n is 0, 1 or 2 and
Z is OH, CHO; C(O)C$_1$-C$_4$-alkyl; COOH, C(CH$_2$)—CH=CH$_2$;  C(OH)(CH$_3$)—CH=CH$_2$; C(CH$_3$)=CH—CH=CH$_2$; or a radical of the formula C(CH$_3$)=CH—CH$_2$Y
in which
Y is OH, CH$_2$OH, COOH, or CH$_2$C(O)CH$_3$; or
(2) when "a" is a single bond:
$R_1$ is selected from the group consisting of:
CH$_3$; CHO; CH$_2$CH$_2$OH; CH=CH$_2$; CH$_2$C(O)OH; CH$_2$CHO; and C$_3$H$_6$CH(CH$_3$)CHO;
and, when "a" is a double bond, it has E or Z configuration;
$R_2$ and $R_3$ are defined as:
(1) when "a" and "b" are each a single bond:
$R_2$ and $R_3$ independently of one another are H, C$_1$-C$_4$-alkyl, or OH, or $R_2$ and $R_3$ together are a methylene (=CH$_2$) or oxo (=O) group; or
(2) when "a" or "b" is a double bond, one of the radicals $R_2$ and $R_3$ is absent and the other of the two radicals is H, C$_1$-C$_4$-alkyl, or OH;
$R_4$ is H or hydroxy-C$_1$-C$_4$-alkyl;
$R_5$ and $R_6$ are defined as:
(1) when "c" is a single bond:
$R_5$ and $R_6$ are each H, or $R_5$ and $R_6$ together are an oxo (=O) group; or
(2) when "c" is a double bond, one of the radicals $R_5$ and $R_6$ is absent and the other of the two radicals is H;
$R_7$, $R_8$, and $R_9$ are defined as:
(1) when "d" is a single bond:
two of the radicals $R_7$, $R_8$ and $R_9$ in each case independently of one another are H or C$_1$-C$_4$-alkyl, and the other of the radicals is OH; or
(2) when "d" is a double bond, one of the radicals $R_7$, $R_8$ and $R_9$ is absent and the other of the two radicals in each case independently of one another are H or C$_1$-C$_4$-alkyl;
$R_{10}$ is H or hydroxy-C$_1$-C$_6$-alkyl or mono- or polyunsaturated C$_2$-C$_6$-alkenyl;
comprising reacting a compound of the formula IV in stereoisomerically pure form, or a stereoisomer mixture thereof:
a) using an enzyme mutant with cyclase activity which is a mutant of a wild-type enzyme comprising the amino acid sequence of SEQ ID NO: 2 with a mutation at a position corresponding to position F486 of the amino acid sequence of SEQ ID NO: 2,
wherein up to 10% of the amino acid residues in said enzyme mutant are altered relative to SEQ ID NO: 2 by deletion, insertion, substitution, addition, inversion, or a combination thereof; or
b) in the presence of a microorganism expressing said enzyme mutant, wherein the microorganism comprises:
i) at least one nucleic acid sequence coding for said enzyme mutant;
ii) at least one expression cassette comprising said at least one nucleic acid sequence; or
iii) at least one vector comprising, under the control of at least one regulatory element, said at least one nucleic acid sequence or said at least one expression cassette.

3. The method of claim 2, comprising converting a compound selected from the group consisting of:

a) compounds of formula IVa

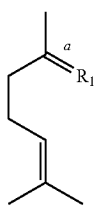

(IVa)

in which $R_1$
i) is defined as:
  (1) when "a" is a double bond:
    $R_1$ is selected from
    oxo (=O), or
    CH—$(CH_2)_n$—Z,
      in which n is 0, 1 or 2 and
      Z is OH, CHO, $C(O)C_1$-$C_4$-alkyl; COOH, $C(CH_2)$=CH—$CH_2$; C(OH)($CH_3$)—CH=$CH_2$; $C(CH_3)$=CH—CH=$CH_2$; or a radical of the formula $C(CH_3)$=CH—$CH_2$Y
      in which
      Y is OH, $CH_2$OH, COOH, or $CH_2$C(O)$CH_3$; or
  (2) when "a" is a single bond:
    $R_1$ is selected from
    $CH_3$; CHO; $CH_2$$CH_2$OH; CH=$CH_2$; $CH_2$C(O)OH; $CH_2$CHO or $C_3H_6$CH($CH_3$)CHO;
  and, when "a" is a double bond, it has E or Z configuration; or
ii) is a radical of the formula
  CH—$(CH_2)_n$—Z
  in which
  n=0 and Z=CHO or COOH;
  n=1 and Z=OH; or
  n=2 and Z=C(O)$CH_3$; COOH, $C(CH_2)$—CH=$CH_2$; $C(CH_3)$=CH—CH=$CH_2$;
iii) is a radical of the formula $C(CH_3)$=CH—$CH_2$Y
  in which Y is OH, $CH_2$OH, COOH, or $CH_2$C(O)$CH_3$;
  and "a" optionally has E or Z configuration;
b) compounds of formula IVb

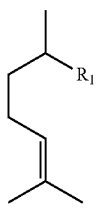

(IVb)

in which $R_1$ is defined as above or is $CH_2$CHO; and c) compounds of formula IVc

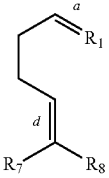

(IVc)

in which
  $R_1$ is defined as above, or is CH—CHO; and one of the radicals $R_7$ and $R_8$ is H and the other is $C_1$-$C_4$-alkyl, or wherein $R_7$ is ethyl and the double bonds "a" and "d" have Z configuration.

4. The method of claim 2, in which the compound of formula IV is selected from citronellal, citral, farnesol, homofarnesol, homofarnesol derivatives, homofarnesylic acid, geranylacetone, melonal, nonadienal, and trimethyldecatetraene.

5. The method of claim 2 for the cyclization of terpenes and/or terpenoids, and for the conversion of compounds of the general formula IV, comprising utilizing:
  (a) said enzyme mutant;
  (b) a nucleic acid coding for said enzyme mutant;
  (c) an expression construct comprising said nucleic acid;
  (d) a recombinant vector comprising, under the control of at least one regulatory element, at least one of the nucleic acid of (b) or at least one of the expression construct of (c); or
  (e) a recombinant microorganism comprising the nucleic acid of (b), the expression construct of (c), or the recombinant vector of (d).

6. The method of claim 5 for the conversion of citronellal to isopulegol, or for the conversion of squalene to hopene.

7. The method of claim 1, wherein up to 5% of the amino acid residues in said enzyme mutant are altered relative to SEQ ID NO: 2 by deletion, insertion, substitution, addition, inversion, or a combination thereof.

8. The method of claim 1, wherein said mutation at the position corresponding to position F486 of the amino acid sequence of SEQ ID NO: 2 is a substitution selected from the group consisting of F486N, F486Q, F486L, F486M, F486E, F486G, F486S, F486V, F486T, F486C, F486I and F486A.

9. The method of claim 1, wherein said enzyme mutant further comprises at least one mutation at positions corresponding to positions W374, D437, D440, F428, W555, Y561, Y702, Y705 of the amino acid sequence of SEQ ID NO: 2.

10. The method of claim 1, wherein said enzyme mutant does not comprise a mutation at a position corresponding to positions D437, D439 and/or D440 of the amino acid sequence of SEQ ID NO: 2.

11. The method of claim 1, wherein said enzyme mutant does not comprise a mutation at a position corresponding to position Y702 of the amino acid sequence of SEQ ID NO: 2.

12. The method of claim 1, wherein said enzyme mutant comprises a mutation at a position corresponding to position Y702 of the amino acid sequence of SEQ ID NO: 2, and wherein said mutation is a Y702F substitution.

13. The method of claim 1, wherein said enzyme mutant further comprises at least one mutation at positions corresponding to positions P229, D439, D508, E601, G553, G556, N432, P436, P499, R224, 5371, T376, T563, W414, or W624 of the amino acid sequence of SEQ ID NO: 2.

14. The method of claim 1, wherein said enzyme mutant is:
a) a single mutant selected from the group consisting of:
  i) F486X, with X=N, Q, L, M, E, G, S, V, T, C, I, or A, of the amino acid sequence of SEQ ID NO: 2;
  ii) Y702X, with X=F, A, C, or S, of the amino acid sequence of SEQ ID NO: 2; and
  iii) Y561X, with X=A or S, of the amino acid sequence of SEQ ID NO: 2;
  or
b) a multiple mutant comprising F486A/Y702A, F486A/Y561A, or F486A/Y705A of the amino acid sequence of SEQ ID NO: 2.

15. The method of claim 2, wherein up to 5% of the amino acid residues in said enzyme mutant are altered relative to SEQ ID NO: 2 by deletion, insertion, substitution, addition, inversion, or a combination thereof.

16. The method of claim 2, wherein said mutation at the position corresponding to position F486 of the amino acid sequence of SEQ ID NO: 2 is a substitution selected from the group consisting of F486N, F486Q, F486L, F486M, F486E, F486G, F486S, F486V, F486T, F486C, F486I and F486A.

17. The method of claim 2, wherein said enzyme mutant further comprises at least one mutation at positions corresponding to positions W374, D437, D440, F428, W555, Y561, Y702, Y705 of the amino acid sequence of SEQ ID NO: 2.

18. The method of claim 2, wherein said enzyme mutant does not comprise a mutation at a position corresponding to positions D437, D439 and/or D440 of the amino acid sequence of SEQ ID NO: 2.

19. The method of claim 2, wherein said enzyme mutant does not comprise a mutation at a position corresponding to position Y702 of the amino acid sequence of SEQ ID NO: 2.

20. The method of claim 2, wherein said enzyme mutant comprises a mutation at a position corresponding to position Y702 of the amino acid sequence of SEQ ID NO: 2, and wherein said mutation is a Y702F substitution.

21. The method of claim 2, wherein said enzyme mutant further comprises at least one mutation at positions corresponding to positions P229, D439, D508, E601, G553, G556, N432, P436, P499, R224, 5371, T376, T563, W414, or W624 of the amino acid sequence of SEQ ID NO: 2.

22. The method of claim 2, wherein said enzyme mutant is:
a) a single mutant selected from the group consisting of:
  i) F486X, with X=N, Q, L, M, E, G, S, V, T, C, I, or A, of the amino acid sequence of SEQ ID NO: 2;
  ii) Y702X, with X=F, A, C, or S, of the amino acid sequence of SEQ ID NO: 2; and
  iii) Y561X, with X=A or S, of the amino acid sequence of SEQ ID NO: 2;
  or
b) a multiple mutant comprising F486A/Y702A, F486A/Y561A, or F486A/Y705A of the amino acid sequence of SEQ ID NO: 2.

* * * * *